US006831165B1

(12) United States Patent
Pompejus et al.

(10) Patent No.: US 6,831,165 B1
(45) Date of Patent: Dec. 14, 2004

(54) *CORYNEBACTERIUM GLUTAMICUM* GENES ENCODING PROTEINS INVOLVED IN HOMEOSTASIS AND ADAPTATION

(75) Inventors: Markus Pompejus, Freinsheim (DE); Burkhard Kröger, Limburgerhof (DE); Hartwig Schröder, Nussloch (DE); Oskar Zelder, Speyer (DE); Gregor Haberhauer, Limburgerhof (DE)

(73) Assignee: BASF Aktiengesellschaft (DE)

( * ) Notice: Subject to any disclaimer, the term of this patent is extended or adjusted under 35 U.S.C. 154(b) by 0 days.

(21) Appl. No.: 09/602,777

(22) Filed: Jun. 23, 2000

Related U.S. Application Data

(60) Provisional application No. 60/141,031, filed on Jun. 25, 1999.

(51) Int. Cl.[7] ............... C07H 21/04; C07K 17/00; C12Q 1/68
(52) U.S. Cl. ............... 536/23.1; 536/24.3; 536/24.32; 536/24.33; 530/350; 435/6
(58) Field of Search ............... 536/23.1, 24.32, 536/24.3, 24.33; 435/6, 91.1, 91.2; 530/350

*Primary Examiner*—Kenneth R. Horlick
*Assistant Examiner*—Cynthia Wilder
(74) *Attorney, Agent, or Firm*—Lahive & Cockfield LLP; Elizabeth A. Hanley; Lisa M. DiRocco

(57) ABSTRACT

Isolated nucleic acid molecules, designated HA nucleic acid molecules, which encode novel HA proteins from *Corynebacterium glutamicum* are described. The invention also provides antisense nucleic acid molecules, recombinant expression vectors containing HA nucleic acid molecules, and host cells into which the expression vectors have been introduced. The invention still further provides isolated HA proteins, mutated HA proteins, fusion proteins, antigenic peptides and methods for the improvement of production of a desired compound from *C. glutamicum* based on genetic engineering of HA genes in this organism.

15 Claims, No Drawings

CORYNEBACTERIUM GLUTAMICUM GENES ENCODING PROTEINS INVOLVED IN HOMEOSTASIS AND ADAPTATION

RELATED APPLICATIONS

This application claims priority to prior filed U.S. Provisional Patent Application Ser. No. 60/141031, filed Jun. 25, 1999. This application also claims priority to prior filed German Patent Application No. 19931636.8, filed Jul. 8, 1999, German Patent Application No. 19932125.6, filed Jul. 9, 1999, German Patent Application No. 19932126.4, filed Jul. 9, 1999, German Patent Application No. 19932127.2, filed Jul. 9, 1999, German Patent Application No. 19932128.0, filed Jul. 9, 1999, German Patent Application No. 19932129.9, filed Jul. 9, 1999, German Patent Application No. 19932226.0, filed Jul. 9, 1999, German Patent Application No. 19932920.6, filed Jul. 14, 1999, German Patent Application No. 19932922.2, filed Jul. 14, 1999, German Patent Application No. 19932924.9, filed Jul. 14, 1999, German Patent Application No. 19932928.1, filed Jul. 14, 1999, German Patent Application No. 19932930.3, filed Jul. 14, 1999, German Patent Application No. 19932933.8, filed Jul. 14, 1999, German Patent Application No. 19932935.4, filed Jul. 14, 1999, German Patent Application No. 19932973.7, filed Jul. 14, 1999, German Patent Application No. 19933002.6, filed Jul. 14, 1999, German Patent Application No. 19933003.4, filed Jul. 14, 1999, German Patent Application No. 19933005.0, filed Jul. 14, 1999, German Patent Application No. 19933006.9, filed Jul. 14, 1999, German Patent Application No. 19941378.9, filed Aug. 31, 1999, German Patent Application No. 19941379.7, filed Aug. 31, 1999, German Patent Application No. 19941390.8, filed Aug. 31, 1999, German Patent Application No. 19941391.6, filed Aug. 31, 1999, and German Patent Application No. 19942088.2, filed September 3, 1999. The entire contents of all of the aforementioned applications are hereby expressly incorporated herein by this reference.

BACKGROUND OF THE INVENTION

Certain products and by-products of naturally-occurring metabolic processes in cells have utility in a wide array of industries, including the food, feed, cosmetics, and pharmaceutical industries. These molecules, collectively termed 'fine chemicals', include organic acids, both proteinogenic and non-proteinogenic amino acids, nucleotides and nucleosides, lipids and fatty acids, diols, carbohydrates, aromatic compounds, vitamins and cofactors, and enzymes. Their production is most conveniently performed through the large-scale culture of bacteria developed to produce and secrete large quantities of one or more desired molecules. One particularly useful organism for this purpose is *Corynebacterium glutamicum*, a gram positive, nonpathogenic bacterium. Through strain selection, a number of mutant strains have been developed which produce an array of desirable compounds. However, selection of strains improved for the production of a particular molecule is a time-consuming and difficult process.

SUMMARY OF THE INVENTION

The invention provides novel bacterial nucleic acid molecules which have a variety of uses. These uses include the identification of microorganisms which can be used to produce fine chemicals, the modulation of fine chemical production in *C. glutamicum* or related bacteria, the typing or identification of *C. glutamicum* or related bacteria, as reference points for mapping the *C. glutamicum* genome, and as markers for transformation. These novel nucleic acid molecules encode proteins, referred to herein as homeostasis and adaptation (HA) proteins.

*C. glutamicum* is a gram positive, aerobic bacterium which is commonly used in industry for the large-scale production of a variety of fine chemicals, and also for the degradation of hydrocarbons (such as in petroleum spills) and for the oxidation of terpenoids. The HA nucleic acid molecules of the invention, therefore, can be used to identify microorganisms which can be used to produce fine chemicals, e.g., by fermentation processes. Modulation of the expression of the HA nucleic acids of the invention, or modification of the sequence of the HA nucleic acid molecules of the invention, can be used to modulate the production of one or more fine chemicals from a microorganism (e.g., to improve the yield or production of one or more fine chemicals from a *Corynebacterium* or *Brevibacterium* species).

The HA nucleic acids of the invention may also be used to identify an organism as being *Corynebacterium glutamicum* or a close relative thereof, or to identify the presence of *C. glutamicum* or a relative thereof in a mixed population of microorganisms. The invention provides the nucleic acid sequences of a number of *C. glutamicum* genes; by probing the extracted genomic DNA of a culture of a unique or mixed population of microorganisms under stringent conditions with a probe spanning a region of a *C. glutamicum* gene which is unique to this organism, one can ascertain whether this organism is present. Although *Corynebacterium glutamicum* itself is nonpathogenic, it is related to species pathogenic in humans, such as *Corynebacterium diphtheriae* (the causative agent of diphtheria); the detection of such organisms is of significant clinical relevance.

The HA nucleic acid molecules of the invention may also serve as reference points for mapping of the *C. glutamicum* genome, or of genomes of related organisms. Similarly, these molecules, or variants or portions thereof, may serve as markers for genetically engineered *Corynebacterium* or *Brevibacterium* species.

e.g.e.g. The HA proteins encoded by the novel nucleic acid molecules of the invention are capable of, for example, performing a function involved in the maintenance of homeostasis in *C. glutamicum*, or in the ability of this microorganism to adapt to different environmental conditions. Given the availability of cloning vectors for use in *Corynebacterium glutamicum*, such as those disclosed in Sinskey et al., U.S. Pat. No. 4,649,119, and techniques for genetic manipulation of *C. glutamicum* and the related Brevibacterium species (e.g., *lactofermentum*) (Yoshihama et al, *J. Bacteriol*. 162: 591–597 (1985); Katsumata et al., *J. Bacteriol*. 159: 306–311 (1984); and Santamaria et al., *J. Gen. Microbiol*. 130: 2237–2246 (1984)), the nucleic acid molecules of the invention may be utilized in the genetic engineering of this organism to make it a better or more efficient producer of one or more fine chemicals. This improved production or efficiency of production of a fine chemical may be due to a direct effect of manipulation of a gene of the invention, or it may be due to an indirect effect of such manipulation.

There are a number of mechanisms by which the alteration of an HA protein of the invention may directly affect the yield, production, and/or efficiency of production of a fine chemical from a *C. glutamicum* strain incorporating such an altered protein. For example, by engineering enzymes which modify or degrade aromatic or aliphatic compounds such that these enzymes are increased or decreased in activity or number, it may be possible to modulate the production of one or more fine chemicals which are the modification or degradation products of these compounds. Similarly, enzymes involved in the metabolism of inorganic compounds provide key molecules (e.g. phosphorous, sulfur, and nitrogen molecules) for the biosynthesis of such fine chemicals as amino acids, vitamins, and nucleic acids. By altering the activity or number of these enzymes in *C. glutamicum*, it may be possible to increase the conversion of these inorganic compounds (or to use alternate inorganic compounds) to thus permit improved rates of incorporation of inorganic atoms into these fine chemicals. Genetic engineering of *C. glutamicum* enzymes involved in general cellular processes may also directly improve fine chemical production, since many of these enzymes directly modify fine chemicals (e.g., amino acids) or the enzymes which are involved in fine chemical synthesis or secretion. Modulation of the activity or number of cellular proteases may also have a direct effect on fine chemical production, since many proteases may degrade fine chemicals or enzymes involved in fine chemical production or breakdown.

Further, the aforementioned enzymes which participate in aromatic/aliphatic compound modification or degradation, general biocatalysis, inorganic compound metabolism or proteolysis are each themselves fine chemicals, desirable for their activity in various in vitro industrial applications. By altering the number of copies of the gene for one or more of these enzymes in *C. glutamicum* it may be possible to increase the number of these proteins produced by the cell, thereby increasing the potential yield or efficiency of production of these proteins from large-scale *C. glutamicum* or related bacterial cultures.

The alteration of an HA protein of the invention may also indirectly affect the yield, production, and/or efficiency of production of a fine chemical from a *C. glutamicum* strain incorporating such an altered protein. For example, by modulating the activity and/or number of those proteins involved in the construction or rearrangement of the cell wall, it may be possible to modify the structure of the cell wall itself such that the cell is able to better withstand the mechanical and other stresses present during large-scale fermentative-culture. Also, large-scale growth of *C. glutamicum* requires significant cell wall production. Modulation of the activity or number of cell wall biosynthetic or degradative enzymes may allow more rapid rates of cell wall biosynthesis, which in turn may permit increased growth rates of this microorganism in culture and thereby increase the number of cells producing the desired fine chemical.

By modifying the HA enzymes of the invention, one may also indirectly impact the yield, production, or efficiency of production of one or more fine chemicals from *C. glutamicum*. For example, many of the general enzymes in *C. glutamicum* may have a significant impact on global cellular processes (e.g., regulatory processes) which in turn have a significant effect on fine chemical metabolism. Similarly, proteases, enzymes which modify or degrade possibly toxic aromatic or aliphatic compounds, and enzymes which promote the metabolism of inorganic compounds all serve to increase the viability of *C. glutamicum*. The proteases aid in the selective removal of misfolded or misregulated proteins, such as those that might occur under the relatively stressful environmental conditions encountered during large-scale fermentor culture. By altering these proteins, it may be possible to further enhance this activity and to improve the viability of *C. glutamicum* in culture. The aromatic/aliphatic modification or degradation proteins not only serve to detoxify these waste compounds (which may be encountered as impurities in culture medium or as waste products from cells themselves), but also to permit the cells to utilize alternate carbon sources if the optimal carbon source is limiting in the culture. By increasing their number and/or activity, the survival of *C. glutamicum* cells in culture may be enhanced. The inorganic metabolism proteins of the invention supply the cell with inorganic molecules required for all protein and nucleotide (among others) synthesis, and thus are critical for the overall viability of the cell. An increase in the number of viable cells producing one or more desired fine chemicals in large-scale culture should result in a concomitant increase in the yield, production, and/or efficiency of production of the fine chemical in the culture.

The invention provides novel nucleic acid molecules which encode proteins, referred to herein as HA proteins, which are capable of, for example, performing a function involved in the maintenance of homeostasis in *C. glutamicum*, or of participating in the ability of this microorganism to adapt to different environmental conditions. Nucleic acid molecules encoding an HA protein are referred to herein as HA nucleic acid molecules. In a preferred embodiment, an HA protein participates in *C. glutamicum* cell wall biosynthesis or rearrangements, metabolism of inorganic compounds, modification or degradation of aromatic or aliphatic compounds, or possesses a *C. glutamicum* enzymatic or proteolytic activity. Examples of such proteins include those encoded by the genes set forth in Table 1.

Accordingly, one aspect of the invention pertains to isolated nucleic acid molecules (e.g., cDNAs, DNAs, or RNAs) comprising a nucleotide sequence encoding an HA protein or biologically active portions thereof, as well as nucleic acid fragments suitable as primers or hybridization probes for the detection or amplification of HA-encoding nucleic acids (e.g., DNA or mRNA). In particularly preferred embodiments, the isolated nucleic acid molecule comprises one of the nucleotide sequences set forth in Appendix A or the coding region or a complement thereof of one of these nucleotide sequences. In other particularly preferred embodiments, the isolated nucleic acid molecule of the invention comprises a nucleotide sequence which hybridizes to or is at least about 50%, preferably at least about 60%, more preferably at least about 70%, 80% or 90%, and even more preferably at least about 95%, 96%, 97%, 98%, 99% or more homologous to a nucleotide sequence set forth in Appendix A, or a portion thereof. In other preferred embodiments, the isolated nucleic acid molecule encodes one of the amino acid sequences set forth in Appendix B. The preferred HA proteins of the present invention also preferably possess at least one of the HA activities described herein.

In another embodiment, the isolated nucleic acid molecule encodes a protein or portion thereof wherein the protein or portion thereof includes an amino acid sequence which is sufficiently homologous to an amino acid sequence of Appendix B, e.g., sufficiently homologous to an amino acid sequence of Appendix B such that the protein or portion thereof maintains an HA activity. Preferably, the protein or portion thereof encoded by the nucleic acid molecule maintains the ability to participate in the maintenance of homeostasis in *C. glutamicum*, or to perform a function involved in the adaptation of this microorganism to different environmental conditions. In one embodiment, the protein encoded by the nucleic acid molecule is at least about 50%, preferably at least about 60%, and more preferably at least about 70%, 80%, or 90% and most preferably at least about 95%, 96%, 97%, 98%, or 99% or more homologous to an amino acid sequence of Appendix B (e.g., an entire amino acid sequence selected from those sequences set forth in Appendix B). In another preferred embodiment, the protein is a full length C. glutamicum protein which is substantially homologous to an entire amino acid sequence of Appendix B (encoded by an open reading frame shown in Appendix A).

In another preferred embodiment, the isolated nucleic acid molecule is derived from C. glutamicum and encodes a protein (e.g., an HA fusion protein) which includes a biologically active domain which is at least about 50% or more homologous to one of the amino acid sequences of Appendix B and is able to participate in the repair or recombination of DNA, in the transposition of genetic material, in gene expression (i.e., the processes of transcription or translation), in protein folding, or in protein secretion in Corynebacterium glutamicum, or has one or more of the activities set forth in Table 1, and which also includes heterologous nucleic acid sequences encoding a heterologous polypeptide or regulatory regions.

In another embodiment, the isolated nucleic acid molecule is at least 15 nucleotides in length and hybridizes under stringent conditions to a nucleic acid molecule comprising a nucleotide sequence of Appendix A. Preferably, the isolated nucleic acid molecule corresponds to a naturally-occurring nucleic acid molecule. More preferably, the isolated nucleic acid encodes a naturally-occurring C. glutamicum HA protein, or a biologically active portion thereof.

Another aspect of the invention pertains to vectors, e.g., recombinant expression vectors, containing the nucleic acid molecules of the invention, and host cells into which such vectors have been introduced. In one embodiment, such a host cell is used to produce an HA protein by culturing the host cell in a suitable medium. The HA protein can be then isolated from the medium or the host cell.

Yet another aspect of the invention pertains to a genetically altered microorganism in which an HA gene has been introduced or altered. In one embodiment, the genome of the microorganism has been altered by introduction of a nucleic acid molecule of the invention encoding wild-type or mutated HA sequence as a transgene. In another embodiment, an endogenous HA gene within the genome of the microorganism has been altered, e.g., functionally disrupted, by homologous recombination with an altered HA gene. In another embodiment, an endogenous or introduced HA gene in a microorganism has been altered by one or more point mutations, deletions, or inversions, but still encodes a functional HA protein. In still another embodiment, one or more of the regulatory regions (e.g., a promoter, repressor, or inducer) of an HA gene in a microorganism has been altered (e.g., by deletion, truncation, inversion, or point mutation) such that the expression of the HA gene is modulated. In a preferred embodiment, the microorganism belongs to the genus Corynebacterium or Brevibacterium, with Corynebacterium glutamicum being particularly preferred. In a preferred embodiment, the microorganism is also utilized for the production of a desired compound, such as an amino acid, with lysine being particularly preferred.

In another aspect, the invention provides a method of identifying the presence or activity of Cornyebacterium diphtheriae in a subject. This method includes detection of one or more of the nucleic acid or amino acid sequences of the invention (e.g., the sequences set forth in Appendix A or Appendix B) in a subject, thereby detecting the presence or activity of Corynebacterium diphtheriae in the subject.

Still another aspect of the invention pertains to an isolated HA protein or a portion, e.g, a biologically active portion, thereof. In a preferred embodiment, the isolated HA protein or portion thereof can participate in the maintenance of homeostasis in C. glutamicum, or can perform a function involved in the adaptation of this microorganism to different environmental conditions. In another preferred embodiment, the isolated HA protein or portion thereof is sufficiently homologous to an amino acid sequence of Appendix B such that the protein or portion thereof maintains the ability to participate in the maintenance of homeostasis in C. glutamicum, or to perform a function involved in the adaptation of this microorganism to different environmental conditions.

The invention also provides an isolated preparation of an HA protein. In preferred embodiments, the HA protein comprises an amino acid sequence of Appendix B. In another preferred embodiment, the invention pertains to an isolated full length protein which is substantially homologous to an entire amino acid sequence of Appendix B (encoded by an open reading frame set forth in Appendix A). In yet another embodiment, the protein is at least about 50%, preferably at least about 60%, and more preferably at least about 70%, 80%, or 90%, and most preferably at least about 95%, 96%, 97%, 98%, or 99% or more homologous to an entire amino acid sequence of Appendix B. In other embodiments, the isolated HA protein comprises an amino acid sequence which is at least about 50% or more homologous to one of the amino acid sequences of Appendix B and is able to participate in the maintenance of homeostasis in C. glutamicum, or to perform a function involved in the adaptation of this microorganism to different environmental conditions, or has one or more of the activities set forth in Table 1.

Alternatively, the isolated HA protein can comprise an amino acid sequence which is encoded by a nucleotide sequence which hybridizes, e.g., hybridizes under stringent conditions, or is at least about 50%, preferably at least about 60%, more preferably at least about 70%, 80%, or 90%, and even more preferably at least about 95%, 96%, 97%, 98%, or 99% or more homologous, to a nucleotide sequence of Appendix B. It is also preferred that the preferred forms of HA proteins also have one or more of the HA bioactivities described herein.

The HA polypeptide, or a biologically active portion thereof, can be operatively linked to a non-HA polypeptide to form a fusion protein. In preferred embodiments, this fusion protein has an activity which differs from that of the HA protein alone. In other preferred embodiments, this fusion protein participates in the maintenance of homeostasis in C. glutamicum, or performs a function involved in the adaptation of this microorganism to different environmental conditions. In particularly preferred embodiments, integration of this fusion protein into a host cell modulates production of a desired compound from the cell.

In another aspect, the invention provides methods for screening molecules which modulate the activity of an HA protein, either by interacting with the protein itself or a substrate or binding partner of the HA protein, or by modulating the transcription or translation of an HA nucleic acid molecule of the invention.

Another aspect of the invention pertains to a method for producing a fine chemical. This method involves the culturing of a cell containing a vector directing the expression of an HA nucleic acid molecule of the invention, such that a fine chemical is produced. In a preferred embodiment, this method further includes the step of obtaining a cell containing such a vector, in which a cell is transfected with a vector directing the expression of an HA nucleic acid. In another preferred embodiment, this method further includes the step of recovering the fine chemical from the culture. In a particularly preferred embodiment, the cell is from the genus *Corynebacterium* or *Brevibacterium*, or is selected from those strains set forth in Table 3.

Another aspect of the invention pertains to methods for modulating production of a molecule from a microorganism. Such methods include contacting the cell with an agent which modulates HA protein activity or HA nucleic acid expression such that a cell associated activity is altered relative to this same activity in the absence of the agent. In a preferred embodiment, the cell is modulated for one or more *C. glutamicum* processes involved in cell wall biosynthesis or rearrangements, metabolism of inorganic compounds, modification or degradation of aromatic or aliphatic compounds, or enzymatic or proteolytic activities. The agent which modulates HA protein activity can be an agent which stimulates HA protein activity or HA nucleic acid expression. Examples of agents which stimulate HA protein activity or HA nucleic acid expression include small molecules, active HA proteins, and nucleic acids encoding HA proteins that have been introduced into the cell. Examples of agents which inhibit HA activity or expression include small molecules and antisense HA nucleic acid molecules.

Another aspect of the invention pertains to methods for modulating yields of a desired compound from a cell, involving the introduction of a wild-type or mutant HA gene into a cell, either maintained on a separate plasmid or integrated into the genome of the host cell. If integrated into the genome, such integration can be random, or it can take place by homologous recombination such that the native gene is replaced by the introduced copy, causing the production of the desired compound from the cell to be modulated. In a preferred embodiment, said yields are increased. In another preferred embodiment, said chemical is a fine chemical. In a particularly preferred embodiment, said fine chemical is an amino acid. In especially preferred embodiments, said amino acid is L-lysine.

DETAILED DESCRIPTION OF THE INVENTION

The present invention provides HA nucleic acid and protein molecules which are involved in *C. glutamicum* cell wall biosynthesis or rearrangements, metabolism of inorganic compounds, modification or degradation of aromatic or aliphatic compounds, or that have a *C. glutamicum* enzymatic or proteolytic activity. The molecules of the invention may be utilized in the modulation of production of fine chemicals from microorganisms, such as *C. glutamicum*, either directly (e.g., where overexpression or optimization of activity of a protein involved in the production of a fine chemical (e.g., an enzyme) has a direct impact on the yield, production, and/or efficiency of production of a fine chemical from the modified *C. glutamicum*), or an indirect impact which nonetheless results in an increase of yield, production, and/or efficiency of production of the desired compound (e.g., where modulation of the activity or number of copies of a *C. glutamicum* aromatic or aliphatic modification or degradation protein results in an increase in the viability of *C. glutamicum* cells, which in turn permits increased production in a large-scale culture setting). Aspects of the invention are further explicated below.

I. Fine Chemicals

The term 'fine chemical' is art-recognized and includes molecules produced by an organism which have applications in various industries, such as, but not limited to, the pharmaceutical, agriculture, and cosmetics industries. Such compounds include organic acids, such as tartaric acid, itaconic acid, and diaminopimelic acid, both proteinogenic and non-proteinogenic amino acids, purine and pyrimidine bases, nucleosides, and nucleotides (as described e.g. in Kuninaka, A. (1996) Nucleotides and related compounds, p. 561–612, in Biotechnology vol. 6, Rehm et al., eds. VCH: Weinheim, and references contained therein), lipids, both saturated and unsaturated fatty acids (e.g., arachidonic acid), diols (e.g., propane diol, and butane diol), carbohydrates (e.g., hyaluronic acid and trehalose), aromatic compounds (e.g., aromatic amines, vanillin, and indigo), vitamins and cofactors (as described in Ulimann's Encyclopedia of Industrial Chemistry, vol. A27, "Vitamins", p. 443–613 (1996) VCH: Weinheim and references therein; and Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research—Asia, held Sep. 1–3, 1994 at Penang, Malaysia, AOCS Press, (1995)), enzymes, polyketides (Cane et al. (1998) *Science* 282: 63–68), and all other chemicals described in Gutcho (1983) Chemicals by Fermentation, Noyes Data Corporation, ISBN: 0818805086 and references therein. The metabolism and uses of certain of these fine chemicals are further explicated below.

A. Amino Acid Metabolism and Uses

Amino acids comprise the basic structural units of all proteins, and as such are essential for normal cellular functioning in all organisms. The term "amino acid" is art-recognized. The proteinogenic amino acids, of which there are 20 species, serve as structural units for proteins, in which they are linked by peptide bonds, while the nonproteinogenic amino acids (hundreds of which are known) are not normally found in proteins (see Ulmann's Encyclopedia of Industrial Chemistry, vol. A2, p. 57–97 VCH: Weinheim (1985)). Amino acids may be in the D- or L- optical configuration, though L-amino acids are generally the only type found in naturally-occurring proteins. Biosynthetic and degradative pathways of each of the 20 proteinogenic amino acids have been well characterized in both prokaryotic and eukaryotic cells (see, for example, Stryer, L. Biochemistry, $3^{rd}$ edition, pages 578–590 (1988)). The 'essential' amino acids (histidine, isoleucine, leucine, lysine, methionine, phenylalanine, threonine, tryptophan, and valine), so named because they are generally a nutritional requirement due to the complexity of their biosyntheses, are readily converted by simple biosynthetic pathways to the remaining 11 'nonessential' amino acids (alanine, arginine, asparagine, aspartate, cysteine, glutamate, glutamine, glycine, proline, serine, and tyrosine). Higher animals do retain the ability to synthesize some of these amino acids, but the essential amino acids must be supplied from the diet in order for normal protein synthesis to occur.

Aside from their function in protein biosynthesis, these amino acids are interesting chemicals in their own right, and many have been found to have various applications in the food, feed, chemical, cosmetics, agriculture, and pharmaceutical industries. Lysine is an important amino acid in the nutrition not only of humans, but also of monogastric animals such as poultry and swine. Glutamate is most commonly used as a flavor additive (mono-sodium glutamate, MSG) and is widely used throughout the food industry, as are aspartate, phenylalanine, glycine, and cysteine. Glycine, L-methionine and tryptophan are all utilized in the pharmaceutical industry. Glutamine, valine, leucine, isoleucine, histidine, arginine, proline, serine and alanine are of use in both the pharmaceutical and cosmetics industries. Threonine, tryptophan, and D/L-methionine are common feed additives. (Leuchtenberger, W. (1996) Amino aids—technical production and use, p. 466–502 in Rehm et al. (eds.) Biotechnology vol. 6, chapter 14a, VCH: Weinheim). Additionally, these amino acids have been found to be useful as precursors for the synthesis of synthetic amino acids and proteins, such as N-acetylcysteine, S-carboxymethyl-L-cysteine, (S)-5-hydroxytryptophan, and others described in Ulmann's Encyclopedia of Industrial Chemistry, vol. A2, p. 57–97, VCH: Weinheim, 1985.

The biosynthesis of these natural amino acids in organisms capable of producing them, such as bacteria, has been well characterized (for review of bacterial amino acid biosynthesis and regulation thereof, see Umbarger, H. E.(1978) *Ann. Rev. Biochem.* 47: 533–606). Glutamate is synthesized by the reductive amination of α-ketoglutarate, an intermediate in the citric acid cycle. Glutamine, proline, and arginine are each subsequently produced from glutamate. The biosynthesis of serine is a three-step process beginning with 3-phosphoglycerate (an intermediate in glycolysis), and resulting in this amino acid after oxidation, transamination, and hydrolysis steps. Both cysteine and glycine are produced from serine; the former by the condensation of homocysteine with serine, and the latter by the transferal of the side-chain β-carbon atom to tetrahydrofolate, in a reaction catalyzed by serine transhydroxymethylase. Phenylalanine, and tyrosine are synthesized from the glycolytic and pentose phosphate pathway precursors erythrose 4-phosphate and phosphoenolpyruvate in a 9-step biosynthetic pathway that differ only at the final two steps after synthesis of prephenate. Tryptophan is also produced from these two initial molecules, but its synthesis is an 11-step pathway. Tyrosine may also be synthesized from phenylalanine, in a reaction catalyzed by phenylalanine hydroxylase. Alanine, valine, and leucine are all biosynthetic products of pyruvate, the final product of glycolysis. Aspartate is formed from oxaloacetate, an intermediate of the citric acid cycle. Asparagine, methionine, threonine, and lysine are each produced by the conversion of aspartate. Isoleucine is formed from threonine. A complex 9-step pathway results in the production of histidine from 5-phosphoribosyl-1-pyrophosphate, an activated sugar.

Amino acids in excess of the protein synthesis needs of the cell cannot be stored, and are instead degraded to provide intermediates for the major metabolic pathways of the cell (for review see Stryer, L. Biochemistry $3^{rd}$ ed. Ch. 21 "Amino Acid Degradation and the Urea Cycle" p. 495–516 (1988)). Although the cell is able to convert unwanted amino acids into useful metabolic intermediates, amino acid production is costly in terms of energy, precursor molecules, and the enzymes necessary to synthesize them. Thus it is not surprising that amino acid biosynthesis is regulated by feedback inhibition, in which the presence of a particular amino acid serves to slow or entirely stop its own production (for overview of feedback mechanisms in amino acid biosynthetic pathways, see Stryer, L. Biochemistry $3^{rd}$ ed. Ch. 24: "Biosynthesis of Amino Acids and Heme" p. 575–600 (1988)). Thus, the output of any particular amino acid is limited by the amount of that amino acid present in the cell.

B. Vitamin, Cofactor, and Nutraceutical Metabolism and Uses

Vitamins, cofactors, and nutraceuticals comprise another group of molecules which the higher animals have lost the ability to synthesize and so must ingest, although they are readily synthesized by other organisms such as bacteria. These molecules are either bioactive substances themselves, or are precursors of biologically active substances which may serve as electron carriers or intermediates in a variety of metabolic pathways. Aside from their nutritive value, these compounds also have significant industrial value as coloring agents, antioxidants, and catalysts or other processing aids. (For an overview of the structure, activity, and industrial applications of these compounds, see, for example, Ullman's Encyclopedia of Industrial Chemistry, "Vitamins" vol. A27, p. 443–613, VCH: Weinheim, 1996.) The term "vitamin" is art-recognized, and includes nutrients which are required by an organism for normal functioning, but which that organism cannot synthesize by itself. The group of vitamins may encompass cofactors and nutraceutical compounds. The language "cofactor" includes nonproteinaceous compounds required for a normal enzymatic activity to occur. Such compounds may be organic or inorganic; the cofactor molecules of the invention are preferably organic. The term "nutraceutical" includes dietary supplements having health benefits in plants and animals, particularly humans. Examples of such molecules are vitamins, antioxidants, and also certain lipids (e.g., polyunsaturated fatty acids).

The biosynthesis of these molecules in organisms capable of producing them, such as bacteria, has been largely characterized (Ullman's Encyclopedia of Industrial Chemistry, "Vitamins" vol. A27, p. 443–613, VCH: Weinheim, 1996; Michal, G. (1999) Biochemical Pathways: An Atlas of Biochemistry and Molecular Biology, John Wiley & Sons; Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research—Asia, held Sep. 1–3, 1994 at Penang, Malaysia, AOCS Press: Champaign, IL X, 374 S).

Thiamin (vitamin $B_1$) is produced by the chemical coupling of pyrimidine and thiazole moieties. Riboflavin (vitamin $B_2$) is synthesized from guanosine-5'-triphosphate (GTP) and ribose-5'-phosphate. Riboflavin, in turn, is utilized for the synthesis of flavin mononucleotide (FMN) and flavin adenine dinucleotide (FAD). The family of compounds collectively termed 'vitamin $B_6$' (e.g., pyridoxine, pyridoxamine, pyridoxa-5'-phosphate, and the commercially used pyridoxin hydrochloride) are all derivatives of the common structural unit, 5-hydroxy-6-methylpyridine. Pantothenate (pantothenic acid, (R)-(+)-N-(2,4-dihydroxy-3,3-dimethyl-1-oxobutyl)-β-alanine) can be produced either by chemical synthesis or by fermentation. The final steps in pantothenate biosynthesis consist of the ATP-driven condensation of β-alanine and pantoic acid. The enzymes responsible for the biosynthesis steps for the conversion to pantoic acid, to β-alanine and for the condensation to panthotenic acid are known. The metabolically active form of pantothenate is Coenzyme A, for which the biosynthesis proceeds in 5 enzymatic steps. Pantothenate, pyridoxal-5'-phosphate, cysteine and ATP are the precursors of Coenzyme A. These enzymes not only catalyze the formation of panthothante, but also the production of (R)-pantoic acid, (R)-pantolacton, (R)-panthenol (provitamin $B_5$), pantetheine (and its derivatives) and coenzyme A.

Biotin biosynthesis from the precursor molecule pimeloyl-CoA in microorganisms has been studied in detail and several of the genes involved have been identified. Many of the corresponding proteins have been found to also be involved in Fe-cluster synthesis and are members of the nifS class of proteins. Lipoic acid is derived from octanoic acid, and serves as a coenzyme in energy metabolism, where it becomes part of the pyruvate dehydrogenase complex and the a-ketoglutarate dehydrogenase complex. The folates are a group of substances which are all derivatives of folic acid, which is turn is derived from L-glutamic acid, p-aminobenzoic acid and 6-methylpterin. The biosynthesis of folic acid and its derivatives, starting from the metabolism intermediates guanosine-5'-triphosphate (GTP), L-glutamic acid and p-amino-benzoic acid has been studied in detail in certain microorganisms.

Corrinoids (such as the cobalamines and particularly vitamin $B_{12}$) and porphyrines belong to a group of chemicals characterized by a tetrapyrole ring system. The biosynthesis of vitamin $B_{12}$ is sufficiently complex that it has not yet been completely characterized, but many of the enzymes and substrates involved are now known. Nicotinic acid (nicotinate), and nicotinamide are pyridine derivatives which are also termed 'niacin'. Niacin is the precursor of the important coenzymes NAD (nicotinamide adenine dinucleotide) and NADP (nicotinamide adenine dinucleotide phosphate) and their reduced forms.

The large-scale production of these compounds has largely relied on cell-free chemical syntheses, though some of these chemicals have also been produced by large-scale culture of microorganisms, such as riboflavin, Vitamin $B_6$, pantothenate, and biotin. Only Vitamin $B_{12}$ is produced solely by fermentation, due to the complexity of its synthesis. In vitro methodologies require significant inputs of materials and time, often at great cost.

C. Purine, Pyrimidine, Nucleoside and Nucleotide Metabolism and Uses

Purine and pyrimidine metabolism genes and their corresponding proteins are important targets for the therapy of tumor diseases and viral infections. The language "purine" or "pyrimidine" includes the nitrogenous bases which are constituents of nucleic acids, co-enzymes, and nucleotides. The term "nucleotide" includes the basic structural units of nucleic acid molecules, which are comprised of a nitrogenous base, a pentose sugar (in the case of RNA, the sugar is ribose; in the case of DNA, the sugar is D-deoxyribose), and phosphoric acid. The language "nucleoside" includes molecules which serve as precursors to nucleotides, but which are lacking the phosphoric acid moiety that nucleotides possess. By inhibiting the biosynthesis of these molecules, or their mobilization to form nucleic acid molecules, it is possible to inhibit RNA and DNA synthesis; by inhibiting this activity in a fashion targeted to cancerous cells, the ability of tumor cells to divide and replicate may be inhibited. Additionally, there are nucleotides which do not form nucleic acid molecules, but rather serve as energy stores (i.e., AMP) or as coenzymes (i.e., FAD and NAD).

Several publications have described the use of these chemicals for these medical indications, by influencing purine and/or pyrimidine metabolism (e.g. Christopherson, R. I. and Lyons, S. D. (1990) "Potent inhibitors of de novo pyrimidine and purine biosynthesis as chemotherapeutic agents." Med. Res. Reviews 10: 505–548). Studies of enzymes involved in purine and pyrimidine metabolism have been focused on the development of new drugs which can be used, for example, as immunosuppressants or anti-proliferants (Smith, J. L., (1995) "Enzymes in nucleotide synthesis." Curr. Opin. Struct. Biol. 5: 752–757; (1995) Biochem Soc. Transact. 23: 877–902). However, purine and pyrimidine bases, nucleosides and nucleotides have other utilities: as intermediates in the biosynthesis of several fine chemicals (e.g., thiamine, S-adenosyl-methionine, folates, or riboflavin), as energy carriers for the cell (e.g., ATP or GTP), and for chemicals themselves, commonly used as flavor enhancers (e.g., IMP or GMP) or for several medicinal applications (see, for example, Kuninaka, A. (1996) Nucleotides and Related Compounds in Biotechnology vol. 6, Rehm et al., eds. VCH: Weinheim, p. 561–612). Also, enzymes involved in purine, pyrimidine, nucleoside, or nucleotide metabolism are increasingly serving as targets against which chemicals for crop protection, including fungicides, herbicides and insecticides, are developed.

The metabolism of these compounds in bacteria has been characterized (for reviews see, for example, Zalkin, H. and Dixon, J. E. (1992) "de novo purine nucleotide biosynthesis", in: Progress in Nucleic Acid Research and Molecular Biology, vol. 42, Academic Press:, p. 259–287; and Michal, G. (1999) "Nucleotides and Nucleosides", Chapter 8 in: Biochemical Pathways: An Atlas of Biochemistry and Molecular Biology, Wiley: New York). Purine metabolism has been the subject of intensive research, and is essential to the normal functioning of the cell. Impaired purine metabolism in higher animals can cause severe disease, such as gout. Purine nucleotides are synthesized from ribose-5-phosphate, in a series of steps through the intermediate compound inosine-5'-phosphate (IMP), resulting in the production of guanosine-5'-monophosphate (GMP) or adenosine-5'-monophosphate (AMP), from which the triphosphate forms utilized as nucleotides are readily formed. These compounds are also utilized as energy stores, so their degradation provides energy for many different biochemical processes in the cell. Pyrimidine biosynthesis proceeds by the formation of uridine-5'-monophosphate (UMP) from ribose-5-phosphate. UMP, in turn, is converted to cytidine-5'-triphosphate (CTP). The deoxy- forms of all of these nucleotides are produced in a one step reduction reaction from the diphosphate ribose form of the nucleotide to the diphosphate deoxyribose form of the nucleotide. Upon phosphorylation, these molecules are able to participate in DNA synthesis.

D. Trehalose Metabolism and Uses

Trehalose consists of two glucose molecules, bound in α, α-1,1 linkage. It is commonly used in the food industry as a sweetener, an additive for dried or frozen foods, and in beverages. However, it also has applications in the pharmaceutical, cosmetics and biotechnology industries (see, for example, Nishimoto et al., (1998) U.S. Pat. No. 5,759,610; Singer, M. A. and Lindquist, S. (1998) Trends Biotech. 16: 460–467; Paiva, C. L. A. and Panek, A. D. (1996) Biotech. Ann. Rev. 2: 293–314; and Shiosaka, M. (1997) J. Japan 172: 97–102). Trehalose is produced by enzymes from many microorganisms and is naturally released into the surrounding medium, from which it can be collected using methods known in the art.

II. Maintenance of Homeostasis in C. glutamicum and Environmental Adaptation

The metabolic and other biochemical processes by which cells function are sensitive to environmental conditions such as temperature, pressure, solute concentration, and availability of oxygen. When one or more such environmental condition is perturbed or altered in a fashion that is incompatible with the normal functioning of these cellular processes, the cell must act to maintain an intracellular environment which will permit them to occur despite the hostile extracellular environment. Gram positive bacterial cells, such as C. glutamicum cells, have a number of mechanisms by which internal homeostasis may be maintained despite unfavorable extracellular conditions. These include a cell wall, proteins which are able to degrade possibly toxic aromatic and aliphatic compounds, mechanisms of proteolysis whereby misfolded or misregulated proteins may be rapidly destroyed, and catalysts which permit intracellular reactions to occur which would not normally take place under the conditions optimal for bacterial growth.

Aside from merely surviving in a hostile environment, bacterial cells (e.g. *C. glutamicum* cells) are also frequently able to adapt such that they are able to take advantage of such conditions. For example, cells in an environment lacking desired carbon sources may be able to adapt to growth on a less-suitable carbon source. Also, cells may be able to utilize less desirable inorganic compounds when the commonly utilized ones are unavailable. *C. glutamicum* cells possess a number of genes which permit them to adapt to utilize inorganic and organic molecules which they would normally not encounter under optimal growth conditions as nutrients and precursors for metabolism. Aspects of cellular processes involved in homeostasis and adaptation are further explicated below.

A. Modification and Degradation of Aromatic and Aliphatic Compounds

Bacterial cells are routinely exposed to a variety of aromatic and aliphatic compounds in nature. Aromatic compounds are organic molecules having a cyclic ring structure, while aliphatic compounds are organic molecules having open chain structures rather than ring structures. Such compounds may arise as by products of industrial processes (e.g., benzene or toluene), but may also be produced by certain microorganisms (e.g., alcohols). Many of these compounds are toxic to cells, particularly the aromatic compounds, which are highly reactive due to the high-energy ring structure. Thus, certain bacteria have developed mechanisms by which they are able to modify or degrade these compounds such that they are no longer hazardous to the cell. Cells may possess enzymes that are able to, for example, hydroxylate, isomerize, or methylate aromatic or aliphatic compounds such that they are either rendered less toxic, or such that the modified form is able to be processed by standard cellular waste and degradation pathways. Also, cells may possess enzymes which are able to specifically degrade one or more such potentially hazardous substance, thereby protecting the cell. Principles and examples of these types of modification and degradation processes in bacteria are described in several publications, e.g., Sahm, H. (1999) "Procaryotes in Industrial Production" in Lengeler, J. W. et al., eds. Biology of the Procaryotes, Thieme Verlag: Stuttgart; and Schlegel, H. G. (1992) Allgemeine Mikrobiologie, Thieme: Stuttgart).

Aside from simply inactivating hazardous aromatic or aliphatic compounds, many bacteria have evolved to be able to utilize these compounds as carbon sources for continued metabolism when the preferred carbon sources of the cell are not available. For example, Pseudomonas strains able to utilize toluene, benzene, and 1,10-dichlorodecane as carbon sources are known (Chang, B. V. et al. (1997) *Chemosphere* 35(12): 2807–2815; Wischnak, C. et al. (1998) *Appl. Environ. Microbiol.* 64(9): 3507–3511; Churchill, S. A. et al. (1999) *Appl. Environ. Microbiol.* 65(2): 549–552). There are similar examples from many other bacterial species which are known in the art.

The ability of certain bacteria to modify or degrade aromatic and aliphatic compounds has begun to be exploited. Petroleum is a complex mixture of chemicals which includes aliphatic molecules and aromatic compounds. By applying bacteria having the ability to degrade or modify these toxic compounds to an oil spill, for example, it is possible to eliminate much of the environmental damage with high efficiency and low cost (see, for example, Smith, M. R. (1990) "The biodegradation of aromatic hydrocarbons by bacteria" *Biodegradation* 1(2–3): 191–206; and Suyama, T. et al. (1998) "Bacterial isolates degrading aliphatic polycarbonates," *FEMS Microbiol. Lett.* 161(2): 255–261).

B. Metabolism of Inorganic Compounds

Cells (e.g., bacterial cells) contain large quantities of different molecules, such as water, inorganic ions, and organic substances (e.g., proteins, sugars, and other macromolecules). The bulk of the mass of a typical cell consists of only 4 types of atoms: carbon, oxygen, hydrogen, and nitrogen. Although they represent a smaller percentage of the content of a cell, inorganic substances are equally as important to the proper functioning of the cell. Such molecules include phosphorous, sulfur, calcium, magnesium, iron, zinc, manganese, copper, molybdenum, tungsten, and cobalt. Many of these compounds are critical for the construction of important molecules, such as nucleotides (phosphorous) and amino acids (nitrogen and sulfur). Others of these inorganic ions serve as cofactors for enzymic reactions or contribute to osmotic pressure. All such molecules must be taken up by the bacterium from the surrounding environment.

For each of these inorganic compounds it is desirable for the bacterium to take up the form which can be most readily used by the standard metabolic machinery of the cell. However, the bacterium may encounter environments in which these preferred forms are not readily available. In order to survive under these circumstances, it is important for bacteria to have additional biochemical mechanisms which are able to convert less metabolically active but readily available forms of these inorganic compounds to ones which may be used in cellular metabolism. Bacteria frequently possess a number of genes encoding enzymes for this purpose, which are not expressed unless the desired inorganic species are not available. Thus, these genes for the metabolism of various inorganic compounds serve as another tool which bacteria may use to adapt to suboptimal environmental conditions.

After carbon, the most important element in the cell is nitrogen. A typical bacterial cell contains between 12–15% nitrogen. It is a constituent of amino acids and nucleotides, as well as many other important molecules in the cell. Further, nitrogen may serve as a substitute for oxygen as a terminal electron acceptor in energy metabolism. Good sources of nitrogen include many organic and inorganic compounds, such ammonia gas or ammonia salts (e.g., $NH_4Cl$, $(NH_4)_2SO_4$, or $NH_4OH$), nitrates, urea, amino acids, or complex nitrogen sources like corn steep liquor, soy bean flour, soy bean protein, yeast extract, meat extract, etc. Ammonia nitrogen is fixed by the action of particular enzymes: glutamate dehydrogenase, glutamine synthase, and glutamine-2-oxoglutarate aminotransferase. The transfer of amino-nitrogen from one organic molecule to another is accomplished by the aminotransferases, a class of enzymes which transfer one amino group from an alpha-amino acid to an alpha-keto acid. Nitrate may be reduced via nitrate reductase, nitrite reductase, and further redox enzymes until it is converted to molecular nitrogen or ammonia, which may be readily utilized by the cell in standard metabolic pathways.

Phosphorous is typically found intracellularly in both organic and inorganic forms, and may be taken up by the cell in either of these forms as well, though most microorganisms preferentially take up inorganic phosphate. The conversion of organic phosphate to a form which the cell can utilize requires the action of phosphatases (e.g., phytases, which hydrolyze phyate-yielding phosphate and inositol derivatives). Phosphate is a key element in the synthesis of nucleic acids, and also has a significant role in cellular energy metabolism (e.g., in the synthesis of ATP, ADP, and AMP).

Sulfur is a requirement for the synthesis of amino acids (e.g., methionine and cysteine), vitamins (e.g., thiamine, biotin, and lipoic acid) and iron sulfur proteins. Bacteria obtain sulfur primarily from inorganic sulfate, though thiosulfate, sulfite, and sulfide are also commonly utilized. Under conditions where these compounds may not be readily available, many bacteria express genes which enable them to utilize sulfonate compounds such as 2-aminosulfonate (taurine) (Kertesz, M. A. (1993) "Proteins induced by sulfate limitation in *Escherichia coli, Pseudomonas putida,* or *Staphylococcus aureus." J. Bacteriol.* 175: 1187–1190).

Other inorganic atoms, e.g., metal or calcium ions, are also critical for the viability of cells. Iron, for example, plays a key role in redox reactions and is a cofactor of iron-sulfur proteins, heme proteins, and cytochromes. The uptake of iron into bacterial cells may be accomplished by the action of siderophores, chelating agents which bind extracellular iron ions and translocate them to the interior of the cell. For reference on the metabolism of iron and other inorganic compounds, see: Lengeler et al. (1999) Biology of Prokaryotes, Thieme Verlag: Stuttgart; Neidhardt, F. C. et al., eds. *Escherichia coli* and Salmonella. ASM Press: Washington, D.C.; Sonenshein, A. L. et al., eds. (199?) *Bacillus subtilis* and Other Gram-Positive Bacteria, ASM Press: Washington, D.C.; Voet, D. and Voet, J. G. (1992) Biochemie, VCH: Weinheim; Brock, T. D. and Madigan, M. T. (1991) Biology of Microorgansisms, 6$^{th}$ ed. Prentice Hall: Englewood Cliffs, p. 267–269; Rhodes, P. M. and Stanbury, P. F. Applied Microbial Physiology —A Practical Approach, Oxford Univ. Press: Oxford.

C. Enzymes and Proteolysis

The intracellular conditions for which bacteria such as *C. glutamicum* are optimized are frequently not conditions under which many biochemical reactions would normally take place. In order to make such reactions proceed under physiological conditions, cells utilize enzymes. Enzymes are proteinaceous biological catalysts, spatially orienting reacting molecules or providing a specialized environment such that the energy barrier to a biochemical reaction is lowered. Different enzymes catalyze different reactions, and each enzyme may be the subject of transcriptional, translational, or posttranslational regulation such that the reaction will only take place under appropriate conditions and at specified times. Enzymes may contribute to the degradation (e.g., the proteases), synthesis (e.g., the synthases), or modification (e.g., transferases or isomerases) of compounds, all of which enable the production of necessary compounds within the cell. This, in turn, contributes to the maintenance of cellular homeostasis.

However, the fact that enzymes are optimized for activity under the physiological conditions at which the bacterium is most viable means that when environmental conditions are perturbed, there is a significant possibility that enzyme activity will also be perturbed. For example, changes in temperature may result in aberrantly folded proteins, and the same is true for changes of pH—protein folding is largely dependent on electrostatic and hydrophobic interactions of amino acids within the polypeptide chain, so any alteration to the charges on individual amino acids (as might be brought about by a change in cellular pH) may have a profound effect on the ability of the protein to correctly fold. Changes in temperature effectively change the amount of kinetic energy that the polypeptide molecule possesses, which affects the ability of the polypeptide to settle into a correctly folded, energetically stable configuration. Misfolded proteins may be harmful to the cell for two reasons. First, the aberrantly folded protein may have a similarly aberrant activity, or no activity whatsoever. Second, misfolded proteins may lack the conformational regions necessary for proper regulation by other cellular systems and thus may continue to be active but in an uncontrolled fashion.

The cell has a mechanism by which misfolded enzymes and regulatory proteins may be rapidly destroyed before any damage occurs to the cell: proteolysis. Proteins such as those of the la/lon family and those of the Clp family specifically recognize and degrade misfolded proteins (see, e.g., Sherman, M. Y., Goldberg, A. L. (1999) EXS 77: 57–78 and references therein and Porankiewicz J. (1999) *Molec. Microbiol.* 32(3): 449–58, and references therein; Neidhardt, F. C., et al. (1996) *E. coli* and Salmonella, ASM Press: Washington, D.C. and references therein; and Pritchard, G. G., and Coolbear, T. (1993) *FEMS Microbiol. Rev.* 12(1–3): 179–206 and references therein). These enzymes bind to misfolded or unfolded proteins and degrade them in an ATP-dependent manner. Proteolysis thus serves as an important mechanism employed by the cell to prevent damage to normal cellular functions upon environmental changes, and it further permits cells to survive under conditions and in environments which would otherwise be toxic due to misregulated and/or aberrant enzyme or regulatory activity.

Proteolysis also has important functions in the cell under optimal environmental conditions. Within normal metabolic processes, proteases aid in the hydrolysis of peptide bonds, in the catabolism of complex molecules to provide necessary degradation products, and in protein modification. Secreted proteases play an important role in the catabolism of external nutrients even prior to the entry of these compounds into the cell. Further, proteolytic activity itself may serve regulatory functions; sporulation in *B. subtilis* and cell cycle progression in Caulobacter spp. are known to be regulated by key proteolytic events in each of these species (Gottesman, S. (1999) *Curr. Opin. Microbiol.* 2(2): 142–147). Thus, proteolytic processes are key for cellular survival under both suboptimal and optimal environmental conditions, and contribute to the overall maintenance of homeostasis in cells.

D. Cell Wall Production and Rearrangements

While the biochemical machinery of the cell may be able to readily adapt to different and possibly unfavorable environments, cells still require a general mechanism by which they may be protected from the environment. For many bacteria, the cell wall affords such protection, and also plays roles in adhesion, cell growth and division, and transport of desired solutes and waste materials.

In order to function, cells require intracellular concentrations of metabolites and other molecules that are substantially higher than those of the surrounding media. Since these metabolites are largely prevented from leaving the cell due to the presence of the hydrophobic membrane, the tendency of the system is for water molecules to enter the cell from the external medium such that the interior concentrations of solutes match the exterior concentrations. Water molecules are readily able to cross the cellular membrane, and this membrane is not able to withstand the resulting swelling and pressure, which may lead to osmotic lysis of the cell. The rigidity of the cell wall greatly improves the ability of the cell to tolerate these pressures, and offers a further barrier to the unwanted diffusion of these metabolites and desired solutes from the cell. Similarly, the cell wall also serves to prevent unwanted material from entering the cell.

The cell wall also participates in a number of other cellular processes, such as adhesion and cell growth and division. Due to the fact that the cell wall completely surrounds the cell, any interaction of the cell with its surroundings must be mediated by the cell wall. Thus, the cell wall must participate in any adherence of the cell to other cells and to desired surfaces. Further, the cell cannot grow or divide without concomitant changes in the cell wall. Since the protection that the wall affords requires its presence during growth, morphogenesis and multiplication, one of the key steps in cell division is cell wall synthesis within the cell such that a new cell divides from the old. Thus, frequently cell wall biosynthesis is regulated in tandem with cell growth and cell division (see, e.g., Sonenshein, A. L. et al, eds. (1993) *Bacillus subtilis* and Other Gram-Positive Bacteria, ASM: Washington, D.C.).

The structure of the cell wall varies between gram-positive and gram-negative bacteria. However, in both types, the fundamental structural unit of the wall remains similar: an overlapping lattice of two polysaccharides, N-acetyl glucosamine (NAG) and N-acetyl muramic acid (NAM) which are cross-linked by amino acids (most commonly L-alanine, D-glutamate, diaminopimelic acid, and D-alanine), termed 'peptidoglycan'. The processes involved in the synthesis of the cell wall are known (see, e.g., Michal, G., ed. (1999) Biochemical Pathways: An Atlas of Biochemistry and Molecular Biology, Wiley: New York).

In gram-negative bacteria, the inner cellular membrane is coated by a single-layered peptidoglycan (approximately 10 nm thick), termed the murein-sacculus. This peptidoglycan structure is very rigid, and its structure determines the shape of the organism. The outer surface of the murein-sacculus is covered with an outer membrane, containing porins and other membrane proteins, phospholipids, and lipopolysaccharides. To maintain a tight association with the outer membrane, the gram-negative cell wall also has interspersed lipid molecules which serve to anchor it to the surrounding membrane.

In gram-positive bacteria, such as *Corynebacterium glutamicum*, the cytoplasmic membrane is covered by a multi-layered peptidoglycan, which ranges from 20–80 nm in thickness (see, e.g., Lengeler et al. (1999) Biology of Prokaryotes Thieme Verlag: Stuttgart, p. 913–918, p. 875–899, and p. 88–109 and references therein). The gram-positive cell wall also contains teichoic acid, a polymer of glycerol or ribitol linked through phosphate groups. Teichoic acid is also able to associate with amino acids, and forms covalent bonds with muramic acid. Also present in the cell wall may be lipoteichoic acids and teichuronic acids. If present, cellular surface structures such as flagella or capsules will be anchored in this layer as well.

III. Elements and Methods of the Invention

The present invention is based, at least in part, on the discovery of novel molecules, referred to herein as HA nucleic acid and protein molecules, which participate in the maintenance of homeostasis in *C. glutamicum*, or which perform a function involved in the adaptation of this microorganism to different environmental conditions. In one embodiment, the HA molecules participate in *C. glutamicum* cell wall biosynthesis or rearrangements, in the metabolism of inorganic compounds, in the modification or degradation of aromatic or aliphatic compounds, or have an enzymatic or proteolytic activity. In a preferred embodiment, the activity of the HA molecules of the present invention with regard to *C. glutamicum* cell wall biosynthesis or rearrangements, metabolism of inorganic compounds, modification or degradation of aromatic or aliphatic compounds, or enzymatic or proteolytic activity has an impact on the production of a desired fine chemical by this organism. In a particularly preferred embodiment, the HA molecules of the invention are modulated in activity, such that the *C. glutamicum* cellular processes in which the HA molecules participate (e.g., *C. glutamicum* cell wall biosynthesis or rearrangements, metabolism of inorganic compounds, modification or degradation of aromatic or aliphatic compounds, or enzymatic or proteolytic activity) are also altered in activity, resulting either directly or indirectly in a modulation of the yield, production, and/or efficiency of production of a desired fine chemical by *C. glutamicum*.

The language, "HA protein" or "HA polypeptide" includes proteins which participate in a number of cellular processes related to *C. glutamicum* homeostasis or the ability of *C. glutamicum* cells to adapt to unfavorable environmental conditions. For example, an HA protein may be involved in *C. glutamicum* cell wall biosynthesis or rearrangements, in the metabolism of inorganic compounds in *C. glutamicum*, in the modification or degradation of aromatic or aliphatic compounds in *C. glutamicum*, or have a *C. glutamicum* enzymatic or proteolytic activity. Examples of HA proteins include those encoded by the HA genes set forth in Table 1 and Appendix A. The terms "HA gene" or "HA nucleic acid sequence" include nucleic acid sequences encoding an HA protein, which consist of a coding region and also corresponding untranslated 5' and 3' sequence regions. Examples of HA genes include those set forth in Table 1. The terms "production" or "productivity" are art-recognized and include the concentration of the fermentation product (for example, the desired fine chemical) formed within a given time and a given fermentation volume (e.g., kg product per hour per liter). The term "efficiency of production" includes the time required for a particular level of production to be achieved (for example, how long it takes for the cell to attain a particular rate of output of a fine chemical). The term "yield" or "product/carbon yield" is art-recognized and includes the efficiency of the conversion of the carbon source into the product (i.e., fine chemical). This is generally written as, for example, kg product per kg carbon source. By increasing the yield or production of the compound, the quantity of recovered molecules, or of useful recovered molecules of that compound in a given amount of culture over a given amount of time is increased. The terms "biosynthesis" or a "biosynthetic pathway" are art-recognized and include the synthesis of a compound, preferably an organic compound, by a cell from intermediate compounds in what may be a multistep and highly regulated process. The terms "degradation" or a "degradation pathway" are art-recognized and include the breakdown of a compound, preferably an organic compound, by a cell to degradation products (generally speaking, smaller or less complex molecules) in what may be a multistep and highly regulated process. The language "metabolism" is art-recognized and includes the totality of the biochemical reactions that take place in an organism. The metabolism of a particular compound, then, (e.g., the metabolism of an amino acid such as glycine) comprises the overall biosynthetic, modification, and degradation pathways in the cell related to this compound. The term "homeostasis" is art-recognized and includes all of the mechanisms utilized by a cell to maintain a constant intracellular environment despite the prevailing extracellular environmental conditions. A non-limiting example of such processes is the utilization of a cell wall to prevent osmotic lysis due to high intracellular solute concentrations. The term "adaptation" or "adaptation to an environmental condition" is art-recognized and includes mechanisms utilized by the cell to render the cell able to survive under nonpreferred environmental conditions (generally speaking, those environmental conditions in which one or more favored nutrients are absent, or in which an environmental condition such as temperature, pH, osmolarity, oxygen percentage and the like fall outside of the optimal survival range of the cell). Many cells, including *C. glutamicum* cells, possess genes encoding proteins which are expressed under such environmental conditions and which permit continued growth in such suboptimal conditions.

In another embodiment, the HA molecules of the invention are capable of modulating the production of a desired molecule, such as a fine chemical, in a microorganism such as *C. glutamicum*. There are a number of mechanisms by which the alteration of an HA protein of the invention may directly affect the yield, production, and/or efficiency of production of a fine chemical from a *C. glutamicum* strain incorporating such an altered protein. For example, by engineering enzymes which modify or degrade aromatic or aliphatic compounds such that these enzymes are increased or decreased in activity or number, it may be possible to modulate the production of one or more fine chemicals which are the modification or degradation products of these compounds. Similarly, enzymes involved in the metabolism of inorganic compounds provide key molecules (e.g phosphorous, sulfur, and nitrogen molecules) for the biosynthesis of such fine chemicals as amino acids, vitamins, and nucleic acids. By altering the activity or number of these enzymes in *C. glutamicum*, it may be possible to increase the conversion of these inorganic compounds (or to use alternate inorganic compounds) to thus permit improved rates of incorporation of inorganic atoms into these fine chemicals. Genetic engineering of *C. glutamicum* enzymes involved in general cellular processes may also directly improve fine chemical production, since many of these enzymes directly modify fine chemicals (e.g., amino acids) or the enzymes which are involved in fine chemical synthesis or secretion. Modulation of the activity or number of cellular proteases may also have a direct effect on fine chemical production, since many proteases may degrade fine chemicals or enzymes involved in fine chemical production or breakdown.

Further, the aforementioned enzymes which participate in aromatic/aliphatic compound modification or degradation, general biocatalysis, inorganic compound metabolism or proteolysis are each themselves fine chemicals, desirable for their activity in various in vitro industrial applications. By altering the number of copies of the gene for one or more of these enzymes in *C. glutamicum* it may be possible to increase the number of these proteins produced by the cell, thereby increasing the potential yield or efficiency of production of these proteins from large-scale *C. glutamicum* or related bacterial cultures.

The alteration of an HA protein of the invention may also indirectly affect the yield, production, and/or efficiency of production of a fine chemical from a *C. glutamicum* strain incorporating such an altered protein. For example, by modulating the activity and/or number of those proteins involved in the construction or rearrangement of the cell wall, it may be possible to modify the structure of the cell wall itself such that the cell is able to better withstand the mechanical and other stresses present during large-scale fermentative culture. Also, large-scale growth of *C. glutamicum* requires significant cell wall production. Modulation of the activity or number of cell wall biosynthetic or degradative enzymes may allow more rapid rates of cell wall biosynthesis, which in turn may permit increased growth rates of this microorganism in culture and thereby increase the number of cells producing the desired fine chemical.

By modifying the HA enzymes of the invention, one may also indirectly impact the yield, production, or efficiency of production of one or more fine chemicals from *C. glutamicum*. For example, many of the general enzymes in *C. glutamicum* may have a significant impact on global cellular processes (e.g., regulatory processes) which in turn have a significant effect on fine chemical metabolism. Similarly, proteases, enzymes which modify or degrade possibly toxic aromatic or aliphatic compounds, and enzymes which promote the metabolism of inorganic compounds all serve to increase the viability of *C. glutamicum*. The proteases aid in the selective removal of misfolded or misregulated proteins, such as those that might occur under the relatively stressful environmental conditions encountered during large-scale fermentor culture. By altering these proteins, it may be possible to further enhance this activity and to improve the viability of *C. glutamicum* in culture. The aromatic/aliphatic modification or degradation proteins not only serve to detoxify these waste compounds (which may be encountered as impurities in culture medium or as waste products from cells themselves), but also to permit the cells to utilize alternate carbon sources if the optimal carbon source is limiting in the culture. By increasing their number and/or activity, the survival of *C. glutamicum* cells in culture may be enhanced. The inorganic metabolism proteins of the invention supply the cell with inorganic molecules required for all protein and nucleotide (among others) synthesis, and thus are critical for the overall viability of the cell. An increase in the number of viable cells producing one or more desired fine chemicals in large-scale culture should result in a concomitant increase in the yield, production, and/or efficiency of production of the fine chemical in the culture.

The isolated nucleic acid sequences of the invention are contained within the genome of a *Corynebacterium glutamicum* strain available through the American Type Culture Collection, given designation ATCC 13032. The nucleotide sequence of the isolated *C. glutamicum* HA DNAs and the predicted amino acid sequences of the *C. glutamicum* HA proteins are shown in Appendices A and B, respectively. Computational analyses were performed which classified and/or identified these nucleotide sequences as sequences which encode proteins that participate in *C. glutamicum* cell wall biosynthesis or rearrangements, metabolism of inorganic compounds, modification or degradation of aromatic or aliphatic compounds, or that have a *C. glutamicum* enzymatic or proteolytic activity.

The present invention also pertains to proteins which have an amino acid sequence which is substantially homologous to an amino acid sequence of Appendix B. As used herein, a protein which has an amino acid sequence which is substantially homologous to a selected amino acid sequence is least about 50% homologous to the selected amino acid sequence, e.g., the entire selected amino acid sequence. A protein which has an amino acid sequence which is substantially homologous to a selected amino acid sequence can also be least about 50–60%, preferably at least about 60–70%, and more preferably at least about 70–80%, 80–90%, or 90–95%, and most preferably at least about 96%, 97%, 98%, 99% or more homologous to the selected amino acid sequence.

The HA protein or a biologically active portion or fragment thereof of the invention can participate in the maintenance of homeostasis in *C. glutamicum*, or can perform a function involved in the adaptation of this microorganism to different environmental conditions, or have one or more of the activities set forth in Table 1.

Various aspects of the invention are described in further detail in the following subsections.

A. Isolated Nucleic Acid Molecules

One aspect of the invention pertains to isolated nucleic acid molecules that encode HA polypeptides or biologically active portions thereof, as well as nucleic acid fragments sufficient for use as hybridization probes or primers for the identification or amplification of HA-encoding nucleic acid (e.g., HA DNA). As used herein, the term "nucleic acid molecule" is intended to include DNA molecules (e.g., cDNA or genomic DNA) and RNA molecules (e.g., mRNA) and analogs of the DNA or RNA generated using nucleotide analogs. This term also encompasses untranslated sequence located at both the 3' and 5' ends of the coding region of the gene: at least about 100 nucleotides of sequence upstream from the 5' end of the coding region and at least about 20 nucleotides of sequence downstream from the 3'end of the coding region of the gene. The nucleic acid molecule can be single-stranded or double-stranded, but preferably is double-stranded DNA. An "isolated" nucleic acid molecule is one which is separated from other nucleic acid molecules which are present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. For example, in various embodiments, the isolated HA nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived (e.g, a *C. glutamicum* cell). Moreover, an "isolated" nucleic acid molecule, such as a DNA molecule, can be substantially free of other cellular material, or culture medium when produced by recombinant techniques, or chemical precursors or other chemicals when chemically synthesized.

A nucleic acid molecule of the present invention, e.g., a nucleic acid molecule having a nucleotide sequence of Appendix A, or a portion thereof, can be isolated using standard molecular biology techniques and the sequence information provided herein. For example, a *C. glutamicum* HA DNA can be isolated from a *C. glutamicum* library using all or portion of one of the sequences of Appendix A as a hybridization probe and standard hybridization techniques (e.g., as described in Sambrook, J., Fritsh, E. F., and Maniatis, T. *Molecular Cloning: A Laboratory Manual*. 2nd, ed., Cold Spring Harbor Laboratory, Cold Spring Harbor Laboratory Press, Cold Spring Harbor, N.Y., 1989). Moreover, a nucleic acid molecule encompassing all or a portion of one of the sequences of Appendix A can be isolated by the polymerase chain reaction using oligonucleotide primers designed based upon this sequence (e.g., a nucleic acid molecule encompassing all or a portion of one of the sequences of Appendix A can be isolated by the polymerase chain reaction using oligonucleotide primers designed based upon this same sequence of Appendix A). For example, mRNA can be isolated from normal endothelial cells (e.g., by the guanidinium-thiocyanate extraction procedure of Chirgwin et al. (1979) *Biochemistry* 18: 5294–5299) and DNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon one of the nucleotide sequences shown in Appendix A. A nucleic acid of the invention can be amplified using cDNA or, alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to an HA nucleotide sequence can be prepared by standard synthetic techniques, e.g., using an automated DNA synthesizer.

In a preferred embodiment, an isolated nucleic acid molecule of the invention comprises one of the nucleotide sequences shown in Appendix A. The sequences of Appendix A correspond to the *Corynebacterium glutamicum* HA DNAs of the invention. This DNA comprises sequences encoding HA proteins (i.e., the "coding region", indicated in each sequence in Appendix A), as well as 5' untranslated sequences and 3' untranslated sequences, also indicated in Appendix A. Alternatively, the nucleic acid molecule can comprise only the coding region of any of the sequences in Appendix A.

For the purposes of this application, it will be understood that each of the sequences set forth in Appendix A has an identifying RXA, RXN, RXS, or RXC number having the designation "RXA," "RXN," "RXS, or "RXC" followed by 5 digits (i.e., RXA02458, RXN00249, RXS00153, or RXC00963). Each of these sequences comprises up to three parts: a 5' upstream region, a coding region, and a downstream region. Each of these three regions is identified by the same RXA, RXN, RXS, or RXC designation to eliminate confusion. The recitation "one of the sequences in Appendix A", then, refers to any of the sequences in Appendix A, which may be distinguished by their differing RXA, RXN, RXS, or RXC designations. The coding region of each of these sequences is translated into a corresponding amino acid sequence, which is set forth in Appendix B. The sequences of Appendix B are identified by the same RXA, RXN, RXS, or RXC designations as Appendix A, such that they can be readily correlated. For example, the amino acid sequences in Appendix B designated RXA02458, RXN00249, RXS00153, and RXC00963 are translations of the coding regions of the nucleotide sequences of nucleic acid molecules RXA02458, RXN00249, RXS00153, and RXC00963, respectively, in Appendix A. Each of the RXA, RXN, RXS, and RXC nucleotide and amino acid sequences of the invention has also been assigned a SEQ ID NO, as indicated in Table 1.

Several of the genes of the invention are "F-designated genes". An F-designated gene includes those genes set forth in Table 1 which have an 'F' in front of the RXA, RXN, RXS, or RXC designation. For example, SEQ ID NO:5, designated, as indicated on Table 1, as "F RXA00249", is an F-designated gene, as are SEQ ID NOs: 11, 15, and 33 (designated on Table 1 as "F RXA02264", "F RXA02274", and "F RXA00675", respectively).

In one embodiment, the nucleic acid molecules of the present invention are not intended to include those compiled in Table 2. In the case of the dapD gene, a sequence for this gene was published in Wehrmann, A., et al. (1998). *J. Bacteriol.* 180(12): 3159–3165. However, the sequence obtained by the inventors of the present application is significantly longer than the published version. It is believed that the published version relied on an incorrect start codon, and thus represents only a fragment of the actual coding region.

In another preferred embodiment, an isolated nucleic acid molecule of the invention comprises a nucleic acid molecule which is a complement of one of the nucleotide sequences shown in Appendix A, or a portion thereof. A nucleic acid molecule which is complementary to one of the nucleotide sequences shown in Appendix A is one which is sufficiently complementary to one of the nucleotide sequences shown in Appendix A such that it can hybridize to one of the nucleotide sequences shown in Appendix A, thereby forming a stable duplex.

In still another preferred embodiment, an isolated nucleic acid molecule of the invention comprises a nucleotide sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to a nucleotide sequence shown in Appendix A, or a portion thereof. Ranges and identity values intermediate to the above-recited ranges, (e.g., 70–90% identical or 80–95% identical) are also intended to be encompassed by the present invention. For example, ranges of identity values using a combination of any of the above values recited as upper and/or lower limits are intended to be included. In an additional preferred embodiment, an isolated nucleic acid molecule of the invention comprises a nucleotide sequence which hybridizes, e.g., hybridizes under stringent conditions, to one of the nucleotide sequences shown in Appendix A, or a portion thereof.

Moreover, the nucleic acid molecule of the invention can comprise only a portion of the coding region of one of the sequences in Appendix A, for example a fragment which can be used as a probe or primer or a fragment encoding a biologically active portion of an HA protein. The nucleotide sequences determined from the cloning of the HA genes from *C. glutamicum* allows for the generation of probes and primers designed for use in identifying and/or cloning HA homologues in other cell types and organisms, as well as HA homologues from other *Corynebacteria* or related species. The probe/primer typically comprises substantially purified oligonucleotide. The oligonucleotide typically comprises a region of nucleotide sequence that hybridizes under stringent conditions to at least about 12, preferably about 25, more preferably about 40, 50 or 75 consecutive nucleotides of a sense strand of one of the sequences set forth in Appendix A, an anti-sense sequence of one of the sequences set forth in Appendix A, or naturally occurring mutants thereof. Primers based on a nucleotide sequence of Appendix A can be used in PCR reactions to clone HA homologues. Probes based on the HA nucleotide sequences can be used to detect transcripts or genomic sequences encoding the same or homologous proteins. In preferred embodiments, the probe further comprises a label group attached thereto, e.g. the label group can be a radioisotope, a fluorescent compound, an enzyme, or an enzyme co-factor. Such probes can be used as a part of a diagnostic test kit for identifying cells which misexpress an HA protein, such as by measuring a level of an HA-encoding nucleic acid in a sample of cells, e.g., detecting HA mRNA levels or determining whether a genomic HA gene has been mutated or deleted.

In one embodiment, the nucleic acid molecule of the invention encodes a protein or portion thereof which includes an amino acid sequence which is sufficiently homologous to an amino acid sequence of Appendix B such that the protein or portion thereof maintains the ability to participate in the maintenance of homeostasis in *C. glutamicum*, or to perform a function involved in the adaptation of this microorganism to different environmental conditions. As used herein, the language "sufficiently homologous" refers to proteins or portions thereof which have amino acid sequences which include a minimum number of identical or equivalent (e.g., an amino acid residue which has a similar side chain as an amino acid residue in one of the sequences of Appendix B) amino acid residues to an amino acid sequence of Appendix B such that the protein or portion thereof is able to participate in the maintenance of homeostasis in *C. glutamicum*, or to perform a function involved in the adaptation of this microorganism to different environmental conditions. Proteins involved in *C. glutamicum* cell wall biosynthesis or rearrangements, metabolism of inorganic compounds, modification or degradation of aromatic or aliphatic compounds, or that have a *C. glutamicum* enzymatic or proteolytic activity, as described herein, may play a role in the production and secretion of one or more fine chemicals. Examples of such activities are also described herein. Thus, "the function of an HA protein" contributes either directly or indirectly to the yield, production, and/or efficiency of production of one or more fine chemicals. Examples of HA protein activities are set forth in Table 1.

In another embodiment, the protein is at least about 50–60%, preferably at least about 60–70%, and more preferably at least about 70–80%, 80–90%, 90–95%, and most preferably at least about 96%, 97%, 98%, 99% or more homologous to an entire amino acid sequence of Appendix B.

Portions of proteins encoded by the HA nucleic acid molecules of the invention are preferably biologically active portions of one of the HA proteins. As used herein, the term "biologically active portion of an HA protein" is intended to include a portion, e.g., a domain/motif, of an HA protein that can participate in the maintenance of homeostasis in *C. glutamicum*, or that can perform a function involved in the adaptation of this microorganism to different environmental conditions, or has an activity as set forth in Table 1. To determine whether an HA protein or a biologically active portion thereof can participate in *C. glutamicum* cell wall biosynthesis or rearrangements, metabolism of inorganic compounds, modification or degradation of aromatic or aliphatic compounds, or has a *C. glutamicum* enzymatic or proteolytic activity, an assay of enzymatic activity may be performed. Such assay methods are well known to those of ordinary skill in the art, as detailed in Example 8 of the Exemplification.

Additional nucleic acid fragments encoding biologically active portions of an HA protein can be prepared by isolating a portion of one of the sequences in Appendix B, expressing the encoded portion of the HA protein or peptide (e.g., by recombinant expression in vitro) and assessing the activity of the encoded portion of the HA protein or peptide.

The invention further encompasses nucleic acid molecules that differ from one of the nucleotide sequences shown in Appendix A (and portions thereof) due to degeneracy of the genetic code and thus encode the same HA protein as that encoded by the nucleotide sequences shown in Appendix A. In another embodiment, an isolated nucleic acid molecule of the invention has a nucleotide sequence encoding a protein having an amino acid sequence shown in Appendix B. In a still further embodiment, the nucleic acid molecule of the invention encodes a full length *C. glutamicum* protein which is substantially homologous to an amino acid sequence of Appendix B (encoded by an open reading frame shown in Appendix A).

It will be understood by one of ordinary skill in the art that in one embodiment the sequences of the invention are not meant to include the sequences of the prior art, such as those Genbank sequences set forth in Tables 2 or 4 which were available prior to the present invention. In one embodiment, the invention includes nucleotide and amino acid sequences having a percent identity to a nucleotide or amino acid sequence of the invention which is greater than that of a sequence of the prior art (e.g., a Genbank sequence (or the protein encoded by such a sequence) set forth in Tables 2 or 4). For example, the invention includes a nucleotide sequence which is greater than and/or at least 39% identical to the nucleotide sequence designated RXA00471(SEQ ID NO:293), a nucleotide sequence which is greater than and/or at least 41% identical to the nucleotide sequence designated RXA00500 (SEQ ID NO:143), and a nucleotide sequence which is greater than and/or at least 35% identical to the nucleotide sequence designated RXA00502(SEQ ID NO:147). One of ordinary skill in the art would be able to calculate the lower threshold of percent identity for any given sequence of the invention by examining the GAP-calculated percent identity scores set forth in Table 4 for each of the three top hits for the given sequence, and by subtracting the highest GAP-calculated percent identity from 100 percent. One of ordinary skill in the art will also appreciate that nucleic acid and amino acid sequences having percent identities greater than the lower threshold so calculated (e.g., at least 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more identical) are also encompassed by the invention.

In addition to the *C. glutamicum* HA nucleotide sequences shown in Appendix A, it will be appreciated by those of ordinary skill in the art that DNA sequence polymorphisms that lead to changes in the amino acid sequences of HA proteins may exist within a population (e.g, the *C. glutamicum* population). Such genetic polymorphism in the HA gene may exist among individuals within a population due to natural variation. As used herein, the terms "gene" and "recombinant gene" refer to nucleic acid molecules comprising an open reading frame encoding an HA protein, preferably a *C. glutamicum* HA protein. Such natural variations can typically result in 1–5% variance in the nucleotide sequence of the HA gene. Any and all such nucleotide variations and resulting amino acid polymorphisms in HA that are the result of natural variation and that do not alter the functional activity of HA proteins are intended to be within the scope of the invention.

Nucleic acid molecules corresponding to natural variants and non-*C. glutamicum* homologues of the *C. glutamicum* HA DNA of the invention can be isolated based on their homology to the *C. glutamicum* HA nucleic acid disclosed herein using the *C. glutamicum* DNA, or a portion thereof, as a hybridization probe according to standard hybridization techniques under stringent hybridization conditions. Accordingly, in another embodiment, an isolated nucleic acid molecule of the invention is at least 15 nucleotides in length and hybridizes under stringent conditions to the nucleic acid molecule comprising a nucleotide sequence of Appendix A. In other embodiments, the nucleic acid is at least 30, 50, 100, 250 or more nucleotides in length. As used herein, the term "hybridizes under stringent conditions" is intended to describe conditions for hybridization and washing under which nucleotide sequences at least 60% homologous to each other typically remain hybridized to each other. Preferably, the conditions are such that sequences at least about 65%, more preferably at least about 70%, and even more preferably at least about 75% or more homologous to each other typically remain hybridized to each other. Such stringent conditions are known to those of ordinary skill in the art and can be found in *Current Protocols in Molecular Biology*, John Wiley & Sons, N.Y. (1989), 6.3.1–6.3.6. A preferred, non-limiting example of stringent hybridization conditions are hybridization in 6×sodium chloride/sodium citrate (SSC) at about 45° C., followed by one or more washes in 0.2×SSC, 0.1% SDS at 50–65° C. Preferably, an isolated nucleic acid molecule of the invention that hybridizes under stringent conditions to a sequence of Appendix A corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein). In one embodiment, the nucleic acid encodes a natural *C. glutamicum* HA protein.

In addition to naturally-occurring variants of the HA sequence that may exist in the population, one of ordinary skill in the art will further appreciate that changes can be introduced by mutation into a nucleotide sequence of Appendix A, thereby leading to changes in the amino acid sequence of the encoded HA protein, without altering the functional ability of the HA protein. For example, nucleotide substitutions leading to amino acid substitutions at "non-essential" amino acid residues can be made in a sequence of Appendix A. A "non-essential" amino acid residue is a residue that can be altered from the wild-type sequence of one of the HA proteins (Appendix B) without altering the activity of said HA protein, whereas an "essential" amino acid residue is required for HA protein activity. Other amino acid residues, however, (e.g., those that are not conserved or only semi-conserved in the domain having HA activity) may not be essential for activity and thus are likely to be amenable to alteration without altering HA activity.

Accordingly, another aspect of the invention pertains to nucleic acid molecules encoding HA proteins that contain changes in amino acid residues that are not essential for HA activity. Such HA proteins differ in amino acid sequence from a sequence contained in Appendix B yet retain at least one of the HA activities described herein. In one embodiment, the isolated nucleic acid molecule comprises a nucleotide sequence encoding a protein, wherein the protein comprises an amino acid sequence at least about 50% homologous to an amino acid sequence of Appendix B and is capable of participating in the maintenance of homeostasis in *C. glutamicum*, or of performing a function involved in the adaptation of this microorganism to different environmental conditions, or has one or more of the activities set forth in Table 1. Preferably, the protein encoded by the nucleic acid molecule is at least about 50–60% homologous to one of the sequences in Appendix B, more preferably at least about 60–70% homologous to one of the sequences in Appendix B, even more preferably at least about 70–80%, 80–90%, 90–95% homologous to one of the sequences in Appendix B, and most preferably at least about 96%, 97%, 98%, or 99% homologous to one of the sequences in Appendix B.

To determine the percent homology of two amino acid sequences (e.g., one of the sequences of Appendix B and a mutant form thereof) or of two nucleic acids, the sequences are aligned for optimal comparison purposes (e.g., gaps can be introduced in the sequence of one protein or nucleic acid for optimal alignment with the other protein or nucleic acid). The amino acid residues or nucleotides at corresponding amino acid positions or nucleotide positions are then compared. When a position in one sequence (e.g, one of the sequences of Appendix B) is occupied by the same amino acid residue or nucleotide as the corresponding position in the other sequence (e.g., a mutant form of the sequence selected from Appendix B), then the molecules are homologous at that position (i.e., as used herein amino acid or nucleic acid "homology" is equivalent to amino acid or nucleic acid "identity"). The percent homology between the two sequences is a function of the number of identical positions shared by the sequences (i.e., % homology=# of identical positions/total # of positions×100).

An isolated nucleic acid molecule encoding an HA protein homologous to a protein sequence of Appendix B can be created by introducing one or more nucleotide substitutions, additions or deletions into a nucleotide sequence of Appendix A such that one or more amino acid substitutions, additions or deletions are introduced into the encoded protein. Mutations can be introduced into one of the sequences of Appendix A by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in an HA protein is preferably replaced with another amino acid residue from the same side chain family. Alternatively, in another embodiment, mutations can be introduced randomly along all or part of an HA coding sequence, such as by saturation mutagenesis, and the resultant mutants can be screened for an HA activity described herein to identify mutants that retain HA activity. Following mutagenesis of one of the sequences of Appendix A, the encoded protein can be expressed recombinantly and the activity of the protein can be determined using, for example, assays described herein (see Example 8 of the Exemplification).

In addition to the nucleic acid molecules encoding HA proteins described above, another aspect of the invention pertains to isolated nucleic acid molecules which are antisense thereto. An "antisense" nucleic acid comprises a nucleotide sequence which is complementary to a "sense" nucleic acid encoding a protein, e.g., complementary to the coding strand of a double-stranded DNA molecule or complementary to an mRNA sequence. Accordingly, an antisense nucleic acid can hydrogen bond to a sense nucleic acid. The antisense nucleic acid can be complementary to an entire HA coding strand, or to only a portion thereof. In one embodiment, an antisense nucleic acid molecule is antisense to a "coding region" of the coding strand of a nucleotide sequence encoding an HA protein. The term "coding region" refers to the region of the nucleotide sequence comprising codons which are translated into amino acid residues (e.g., the entire coding region of SEQ ID NO. 3 (RXN00249) comprises nucleotides 1 to 957). In another embodiment, the antisense nucleic acid molecule is antisense to a "noncoding region" of the coding strand of a nucleotide sequence encoding HA. The term "noncoding region" refers to 5' and 3' sequences which flank the coding region that are not translated into amino acids (i.e., also referred to as 5' and 3' untranslated regions).

Given the coding strand sequences encoding HA disclosed herein (e.g., the sequences set forth in Appendix A), antisense nucleic acids of the invention can be designed according to the rules of Watson and Crick base pairing. The antisense nucleic acid molecule can be complementary to the entire coding region of HA mRNA, but more preferably is an oligonucleotide which is antisense to only a portion of the coding or noncoding region of HA mRNA. For example, the antisense oligonucleotide can be complementary to the region surrounding the translation start site of HA mRNA. An antisense oligonucleotide can be, for example, about 5, 10, 15, 20, 25, 30, 35, 40, 45 or 50 nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a cell or generated in situ such that they hybridize with or bind to cellular mRNA and/or genomic DNA encoding an HA protein to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic promoter are preferred.

In yet another embodiment, the antisense nucleic acid molecule of the invention is an α-anomeric nucleic acid molecule. An cc-anomeric nucleic acid molecule forms specific double-stranded hybrids with complementary RNA in which, contrary to the usual β-units, the strands run parallel to each other (Gaultier el al. (1987) Nucleic Acids. Res. 15:6625–6641). The antisense nucleic acid molecule can also comprise a 2'-o-methylribonucleotide (Inoue et al. (1987) Nucleic Acids Res. 15:6131–6148) or a chimeric RNA-DNA analogue (Inoue et al. (1987) FEBS Lett. 215:327–330).

In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) Nature 334:585–591)) can be used to catalytically cleave HA mRNA transcripts to thereby inhibit translation of HA mRNA. A ribozyme having specificity for an HA-encoding nucleic acid can be designed based upon the nucleotide sequence of an HA DNA molecule disclosed herein (i.e., SEQ ID NO. 3 (RXN00249) Appendix A). For example, a derivative of a Tetrahymena L-19 IVS RNA can be constructed in which the nucleotide sequence of the active site is complementary to the nucleotide sequence to be cleaved in an HA-encoding mRNA. See, e.g., Cech et al. U.S. Pat. No. 4,987,071 and Cech et al. U.S. Pat. No. 5,116,742. Alternatively, HA mRNA can be used to select a catalytic RNA having a specific ribonuclease activity from a pool of RNA molecules. See, e.g., Bartel, D. and Szostak, J. W. (1993) Science 261:1411–1418.

Alternatively, HA gene expression can be inhibited by targeting nucleotide sequences complementary to the regulatory region of an HA nucleotide sequence (e.g., an HA promoter and/or enhancers) to form triple helical structures that prevent transcription of an HA gene in target cells. See generally, Helene, C. (1991) Anticancer Drug Des. 6(6):569–84; Helene, C. et al. (1992) Ann. N.Y. Acad Sci. 660:27–36; and Maher, L. J. (1992) Bioassays 14(12):807–15.

B. Recombinant Expression Vectors and Host Cells

Another aspect of the invention pertains to vectors, preferably expression vectors, containing a nucleic acid encoding an HA protein (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which are operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel; Gene Expression Technology: Methods in Enzymology 185, Academic Press, San Diego, Calif. (1990). Regulatory sequences include those which direct constitutive expression of a nucleotide sequence in many types of host cell and those which direct expression of the nucleotide sequence only in certain host cells. Preferred regulatory sequences are, for example, promoters such as cos-, tac-, trp-, tet-, trp-tet-, lpp-, lac-, Ipp-lac-, lacI$^q$-, T7-, T5-, T3-, gal-, trc-, ara-, SP6-, arny, SPO2, λ-$P_R$- or λ $P_L$, which are used preferably in bacteria. Additional regulatory sequences are, for example, promoters from yeasts and fungi, such as ADC1, MFα, AC, P-60, CYC1, GAPDH, TEF, rp28, ADH, promoters from plants such as CaMV/35S, SSU, OCS, lib4, usp, STLS1, B33, nos or ubiquitin- or phaseolin-promoters. It is also possible to use artificial promoters. It will be appreciated by those of ordinary skill in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., HA proteins, mutant forms of HA proteins, fusion proteins, etc.).

The recombinant expression vectors of the invention can be designed for expression of HA proteins in prokaryotic or eukaryotic cells. For example, HA genes can be expressed in bacterial cells such as C. glutamicum, insect cells (using baculovirus expression vectors), yeast and other fungal cells (see Romanos, M. A. et al. (1992) "Foreign gene expression in yeast: a review", Yeast 8: 423–488; van den Hondel, C. A. M. J. J. et al. (1991) "Heterologous gene expression in filamentous fumgi" in: More Gene Manipulations in Fungi, J. W. Bennet & L. L. Lasure, eds., p. 396–428: Academic Press: San Diego; and van den Hondel, C. A. M. J. J. & Punt, P. J. (1991) "Gene transfer systems and vector development for filamentous fungi, in: Applied Molecular Genetics of Fungi, Peberdy, J. F. et al., eds., p. 1–28, Cambridge University Press: Cambridge), algae and multicellular plant cells (see Schmidt, R. and Willmitzer, L. (1988) High efficiency *Agrobacterium tumefaciens*—mediated transformation of *Arabidopsis thaliana* leaf and cotyledon explants" *Plant Cell Rep*.: 583–586), or mammalian cells. Suitable host cells are discussed further in Goeddel, *Gene Expression Technology: Methods in Enzymology* 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out with vectors containing constitutive or inducible promoters directing the expression of either fusion or non-fusion proteins. Fusion vectors add a number of amino acids to a protein encoded therein, usually to the amino terminus of the recombinant protein but also to the C-terminus or fused within suitable regions in the proteins. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase.

Typical fusion expression vectors include pGEX (Pharmacia Biotech Inc; Smith, D. B. and Johnson, K. S. (1988) *Gene* 67:31–40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. In one embodiment, the coding sequence of the HA protein is cloned into a pGEX expression vector to create a vector encoding a fusion protein comprising, from the N-terminus to the C-terminus, GST-thrombin cleavage site-X protein. The fusion protein can be purified by affinity chromatography using glutathione-agarose resin. Recombinant HA protein unfused to GST can be recovered by cleavage of the fusion protein with thrombin.

Examples of suitable inducible non-fusion *E. coli* expression vectors include pTrc (Amann et al., (1988) *Gene* 69:301–315) pLG338, pACYC184, pBR322, pUC18, pUC19, pKC30, pRep4, pHS1, pHS2, pPLc236, pMBL24, pLG200, pUR290, pIN-III113-B1, λgt11, pBdC1, and pET 11d (Studier et al., *Gene Expression Technology: Methods in Enzymology* 185, Academic Press, San Diego, Calif. (1990) 60–89; and Pouwels et al., eds. (1985) Cloning Vectors. Elsevier: New York IBSN 0 444 904018). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174(DE3) from a resident λ prophage harboring a T7 gn 1 gene under the transcriptional control of the lacUV 5 promoter. For transformation of other varieties of bacteria, appropriate vectors may be selected. For example, the plasmids pIJ101, pIJ364, pIJ702 and pIJ361 are known to be useful in transforming Streptomyces, while plasmids pUB110, pC194, or pBD214 are suited for transformation of Bacillus species. Several plasmids of use in the transfer of genetic information into *Corynebacterium* include pHM 1519, pBL 1, pSA77, or pAJ667 (Pouwels et al., eds. (1985) Cloning Vectors. Elsevier: New York IBSN 0 444 904018).

One strategy to maximize recombinant protein expression is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy is to alter the nucleic acid sequence of the nucleic acid to be inserted into an expression vector so that the individual codons for each amino acid are those preferentially utilized in the bacterium chosen for expression, such as *C. glutamicum* (Wada et al. (1992) *Nucleic Acids Res*. 20: 21111–2118). Such alteration of nucleic acid sequences of the invention can be carried out by standard DNA synthesis techniques.

In another embodiment, the HA protein expression vector is a yeast expression vector. Examples of vectors for expression in yeast *S. cerevisiae* include pYepSec1 (Baldari, et al., (1987) *Embo J*. 6:229–234), 2μ, pAG-1, Yep6, Yep13, pEMBLYe23, pMFa (Kurjan and Herskowitz, (1982) *Cell* 30:933–943), pJRY88 (Schultz et al., (1987) *Gene* 54:113–123), and pYES2 (Invitrogen Corporation, San Diego, Calif.). Vectors and methods for the construction of vectors appropriate for use in other fungi, such as the filamentous fungi, include those detailed in: van den Hondel, C. A. M. J. J. & Punt, P. J. (1991) "Gene transfer systems and vector development for filamentous fungi, in: Applied Molecular Genetics of Fungi, J. F. Peberdy, et al., eds., p. 1–28, Cambridge University Press: Cambridge, and Pouwels et al., eds. (1985) Cloning Vectors. Elsevier: New York (IBSN 0 444 904018).

Alternatively, the HA proteins of the invention can be expressed in insect cells using baculovirus expression vectors. Baculovirus vectors available for expression of proteins in cultured insect cells (e.g., Sf9 cells) include the pAc series (Smith et al. (1983) *Mol. Cell Biol*. 3:2156–2165) and the pVL series (Lucklow and Summers (1989) *Virology* 170:31–39).

In another embodiment, the HA proteins of the invention may be expressed in unicellular plant cells (such as algae) or in plant cells from higher plants (e.g., the spermatophytes, such as crop plants). Examples of plant expression vectors include those detailed in: Becker, D., Kemper, E., Schell, J. and Masterson, R. (1992) "New plant binary vectors with selectable markers located proximal to the left border", *Plant Mol Biol*. 20: 1195–1197; and Bevan, M. W. (1984) "Binary Agrobacterium vectors for plant transformation", *Nucl. Acid Res*. 12: 8711–8721, and include pLGV23, pGHlac+, pBIN19, pAK2004, and pDH51 (Pouwels et al., eds. (1985) Cloning Vectors. Elsevier: New York IBSN 0 444 904018).

In yet another embodiment, a nucleic acid of the invention is expressed in mammalian cells using a mammalian expression vector. Examples of mammalian expression vectors include pCDM8 (Seed, B. (1987) *Nature* 329:840) and pMT2PC (Kaufman et al. (1987) *EMBO J*. 6:187–195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook, J., Fritsh, E. F., and Maniatis, T. *Molecular Cloning. A Laboratory Manual*. 2nd, ed, Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268–277), lymphoid-specific promoters (Calame and Eaton (1988) *Adv. Immunol.* 43:235–275), in particular promoters of T cell receptors (Winoto and Baltimore (1989) *EMBO J.* 8:729–733) and immunoglobulins (Banerji et al. (1983) *Cell* 33:729–740; Queen and Baltimore (1983) *Cell* 33:741–748), neuron-specific promoters (e.g., the neurofilament promoter; Byrne and Ruddle (1989) *PNAS* 86:5473–5477), pancreas-specific promoters (Edlund et al. (1985) *Science* 230:912–916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) *Science* 249:374–379) and the α-fetoprotein promoter (Campes and Tilghman (1989) *Genes Dev.* 3:537–546).

The invention further provides a recombinant expression vector comprising a DNA molecule of the invention cloned into the expression vector in an antisense orientation. That is, the DNA molecule is operatively linked to a regulatory sequence in a manner which allows for expression (by transcription of the DNA molecule) of an RNA molecule which is antisense to HA mRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see Weintraub, H. et al., Antisense RNA as a molecular tool for genetic analysis, *Reviews—Trends in Genetics*, Vol. 1(1) (1986).

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, an HA protein can be expressed in bacterial cells such as *C. glutamicum*, insect cells, yeast or mammalian cells (such as Chinese hamster ovary cells (CHO) or COS cells). Other suitable host cells are known to those of ordinary skill in the art. Microorganisms related to *Corynebacterium glutamicum* which may be conveniently used as host cells for the nucleic acid and protein molecules of the invention are set forth in Table 3.

Vector DNA can be introduced into prokaryotic or eukaryotic cells via conventional transformation or transfection techniques. As used herein, the terms "transformation" and "transfection", "conjugation" and "transduction" are intended to refer to a variety of art-recognized techniques for introducing foreign nucleic acid (e.g., linear DNA or RNA (e.g., a linearized vector or a gene construct alone without a vector) or nucleic acid in the form of a vector (e.g., a plasmid, phage, phasmid, phagemid, transposon or other DNA) into a host cell, including calcium phosphate or calcium chloride co-precipitation, DEAE-dextran-mediated transfection, lipofection, natural competence, chemical-mediated transfer, or electroporation. Suitable methods for transforming or transfecting host cells can be found in Sambrook, et al. (*Molecular Cloning: A Laboratory Manual. 2nd, ed*, Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin and methotrexate. Nucleic acid encoding a selectable marker can be introduced into a host cell on the same vector as that encoding an HA protein or can be introduced on a separate vector. Cells stably transfected with the introduced nucleic acid can be identified by, for example, drug selection (e.g., cells that have incorporated the selectable marker gene will survive, while the other cells die).

To create a homologous recombinant microorganism, a vector is prepared which contains at least a portion of an HA gene into which a deletion, addition or substitution has been introduced to thereby alter, e.g., functionally disrupt, the HA gene. Preferably, this HA gene is a *Corynebacterium glutamicum* HA gene, but it can be a homologue from a related bacterium or even from a mammalian, yeast, or insect source. In a preferred embodiment, the vector is designed such that, upon homologous recombination, the endogenous HA gene is functionally disrupted (i.e., no longer encodes a functional protein; also referred to as a "knock out" vector). Alternatively, the vector can be designed such that, upon homologous recombination, the endogenous HA gene is mutated or otherwise altered but still encodes functional protein (e.g., the upstream regulatory region can be altered to thereby alter the expression of the endogenous HA protein). In the homologous recombination vector, the altered portion of the HA gene is flanked at its 5' and 3' ends by additional nucleic acid of the HA gene to allow for homologous recombination to occur between the exogenous HA gene carried by the vector and an endogenous HA gene in a microorganism. The additional flanking HA nucleic acid is of sufficient length for successful homologous recombination with the endogenous gene. Typically, several kilobases of flanking DNA (both at the 5' and 3' ends) are included in the vector (see e.g., Thomas, K. R., and Capecchi, M. R. (1987) Cell 51: 503 for a description of homologous recombination vectors). The vector is introduced into a microorganism (e.g., by electroporation) and cells in which the introduced HA gene has homologously recombined with the endogenous HA gene are selected, using art-known techniques.

In another embodiment, recombinant microorganisms can be produced which contain selected systems which allow for regulated expression of the introduced gene. For example, inclusion of an HA gene on a vector placing it under control of the lac operon permits expression of the HA gene only in the presence of IPTG. Such regulatory systems are well known in the art.

In another embodiment, an endogenous HA gene in a host cell is disrupted (e.g., by homologous recombination or other genetic means known in the art) such that expression of its protein product does not occur. In another embodiment, an endogenous or introduced HA gene in a host cell has been altered by one or more point mutations, deletions, or inversions, but still encodes a functional HA protein. In still another embodiment, one or more of the regulatory regions (e.g., a promoter, repressor, or inducer) of an HA gene in a microorganism has been altered (e.g, by deletion, truncation, inversion, or point mutation) such that the expression of the HA gene is modulated. One of ordinary skill in the art will appreciate that host cells containing more than one of the described HA gene and protein modifications may be readily produced using the methods of the invention, and are meant to be included in the present invention.

A host cell of the invention, such as a prokaryotic or eukaryotic host cell in culture, can be used to produce (i.e., express) an HA protein. Accordingly, the invention further provides methods for producing HA proteins using the host cells of the invention. In one embodiment, the method comprises culturing the host cell of invention (into which a recombinant expression vector encoding an HA protein has been introduced, or into which genome has been introduced a gene encoding a wild-type or altered HA protein) in a suitable medium until HA protein is produced. In another embodiment, the method further comprises isolating HA proteins from the medium or the host cell.

C. Isolated HA Proteins

Another aspect of the invention pertains to isolated HA proteins, and biologically active portions thereof An "isolated" or "purified" protein or biologically active portion thereof is substantially free of cellular material when produced by recombinant DNA techniques, or chemical precursors or other chemicals when chemically synthesized. The language "substantially free of cellular material" includes preparations of HA protein in which the protein is separated from cellular components of the cells in which it is naturally or recombinantly produced. In one embodiment, the language "substantially free of cellular material" includes preparations of HA protein having less than about 30% (by dry weight) of non-HA protein (also referred to herein as a "contaminating protein"), more preferably less than about 20% of non-HA protein, still more preferably less than about 10% of non-HA protein, and most preferably less than about 5% non-HA protein. When the HA protein or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations of HA protein in which the protein is separated from chemical precursors or other chemicals which are involved in the synthesis of the protein. In one embodiment, the language "substantially free of chemical precursors or other chemicals" includes preparations of HA protein having less than about 30% (by dry weight) of chemical precursors or non-HA chemicals, more preferably less than about 20% chemical precursors or non-HA chemicals, still more preferably less than about 10% chemical precursors or non-HA chemicals, and most preferably less than about 5% chemical precursors or non-HA chemicals. In preferred embodiments, isolated proteins or biologically active portions thereof lack contaminating proteins from the same organism from which the HA protein is derived. Typically, such proteins are produced by recombinant expression of, for example, a *C. glutamicum* HA protein in a microorganism such as *C. glutamicum.*

An isolated HA protein or a portion thereof of the invention can participate in the repair or recombination of DNA, in the transposition of genetic material, in gene expression (i.e., the processes of transcription or translation), in protein folding, or in protein secretion in *Corynebacterium glutamicum*, or has one or more of the activities set forth in Table 1. In preferred embodiments, the protein or portion thereof comprises an amino acid sequence which is sufficiently homologous to an amino acid sequence of Appendix B such that the protein or portion thereof maintains the ability to participate in the maintenance of homeostasis in *C. glutamicum*, or to perform a function involved in the adaptation of this microorganism to different environmental conditions. The portion of the protein is preferably a biologically active portion as described herein. In another preferred embodiment, an HA protein of the invention has an amino acid sequence shown in Appendix B. In yet another preferred embodiment, the HA protein has an amino acid sequence which is encoded by a nucleotide sequence which hybridizes, e.g., hybridizes under stringent conditions, to a nucleotide sequence of Appendix A. In still another preferred embodiment, the HA protein has an amino acid sequence which is encoded by a nucleotide sequence that is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% % or more homologous to one of the nucleic acid sequences of Appendix A, or a portion thereof. Ranges and identity values intermediate to the above-recited values, (e.g., 70–90% identical or 80–95% identical) are also intended to be encompassed by the present invention. For example, ranges of identity values using a combination of any of the above values recited as upper and/or lower limits are intended to be included. The preferred HA proteins of the present invention also preferably possess at least one of the HA activities described herein. For example, a preferred HA protein of the present invention includes an amino acid sequence encoded by a nucleotide sequence which hybridizes, e.g., hybridizes under stringent conditions, to a nucleotide sequence of Appendix A, and which can participate in the maintenance of homeostasis in *C. glutamicum*, or can perform a function involved in the adaptation of this microorganism to different environmental conditions, or which has one or more of the activities set forth in Table 1.

In other embodiments, the HA protein is substantially homologous to an amino acid sequence of Appendix B and retains the functional activity of the protein of one of the sequences of Appendix B yet differs in amino acid sequence due to natural variation or mutagenesis, as described in detail in subsection I above. Accordingly, in another embodiment, the HA protein is a protein which comprises an amino acid sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to an entire amino acid sequence of Appendix B and which has at least one of the HA activities described herein. Ranges and identity values intermediate to the above-recited values, (e.g., 70–90% identical or 80–95% identical) are also intended to be encompassed by the present invention. For example, ranges of identity values using a combination of any of the above values recited as upper and/or lower limits are intended to be included. In another embodiment, the invention pertains to a full length *C. glutamicum* protein which is substantially homologous to an entire amino acid sequence of Appendix B.

Biologically active portions of an HA protein include peptides comprising amino acid sequences derived from the amino acid sequence of an HA protein, e.g., the an amino acid sequence shown in Appendix B or the amino acid sequence of a protein homologous to an HA protein, which include fewer amino acids than a full length HA protein or the full length protein which is homologous to an HA protein, and exhibit at least one activity of an HA protein. Typically, biologically active portions (peptides, e.g., peptides which are, for example, 5, 10, 15, 20, 30, 35, 36, 37, 38, 39, 40, 50, 100 or more amino acids in length) comprise a domain or motif with at least one activity of an HA protein. Moreover, other biologically active portions, in which other regions of the protein are deleted, can be prepared by recombinant techniques and evaluated for one or more of the activities described herein. Preferably, the biologically active portions of an HA protein include one or more selected domains/motifs or portions thereof having biological activity.

HA proteins are preferably produced by recombinant DNA techniques. For example, a nucleic acid molecule encoding the protein is cloned into an expression vector (as described above), the expression vector is introduced into a host cell (as described above) and the HA protein is expressed in the host cell. The HA protein can then be isolated from the cells by an appropriate purification scheme using standard protein purification techniques. Alternative to recombinant expression, an HA protein, polypeptide, or peptide can be synthesized chemically using standard peptide synthesis techniques. Moreover, native HA protein can be isolated from cells (e.g., endothelial cells), for example using an anti-HA antibody, which can be produced by standard techniques utilizing an HA protein or fragment thereof of this invention.

The invention also provides HA chimeric or fusion proteins. As used herein, an HA "chimeric protein" or "fusion protein" comprises an HA polypeptide operatively linked to a non-HA polypeptide. An "HA polypeptide" refers to a polypeptide having an amino acid sequence corresponding to an HA protein, whereas a "non-HA polypeptide" refers to a polypeptide having an amino acid sequence corresponding to a protein which is not substantially homologous to the HA protein, e.g., a protein which is different from the HA protein and which is derived from the same or a different organism. Within the fusion protein, the term "operatively linked" is intended to indicate that the HA polypeptide and the non-HA polypeptide are fused in-frame to each other. The non-HA polypeptide can be fused to the N-terminus or C-terminus of the HA polypeptide. For example, in one embodiment the fusion protein is a GST-HA fusion protein in which the HA sequences are fused to the C-terminus of the GST sequences. Such fusion proteins can facilitate the purification of recombinant HA proteins. In another embodiment, the fusion protein is an HA protein containing a heterologous signal sequence at its N-terminus. In certain host cells (e.g., mammalian host cells), expression and/or secretion of an HA protein can be increased through use of a heterologous signal sequence.

Preferably, an HA chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). An HA-encoding nucleic acid can be cloned into such an expression vector such that the fusion moiety is linked in-frame to the HA protein.

Homologues of the HA protein can be generated by mutagenesis, e.g., discrete point mutation or truncation of the HA protein. As used herein, the term "homologue" refers to a variant form of the HA protein which acts as an agonist or antagonist of the activity of the HA protein. An agonist of the HA protein can retain substantially the same, or a subset, of the biological activities of the HA protein. An antagonist of the HA protein can inhibit one or more of the activities of the naturally occurring form of the HA protein, by, for example, competitively binding to a downstream or upstream member of a biochemical cascade which includes the HA protein, by binding to a target molecule with which the HA protein interacts, such that no functional interaction is possible, or by binding directly to the HA protein and inhibiting its normal activity.

In an alternative embodiment, homologues of the HA protein can be identified by screening combinatorial libraries of mutants, e.g., truncation mutants, of the HA protein for HA protein agonist or antagonist activity. In one embodiment, a variegated library of HA variants is generated by combinatorial mutagenesis at the nucleic acid level and is encoded by a variegated gene library. A variegated library of HA variants can be produced by, for example, enzymatically ligating a mixture of synthetic oligonucleotides into gene sequences such that a degenerate set of potential HA sequences is expressible as individual polypeptides, or alternatively, as a set of larger fusion proteins (e.g., for phage display) containing the set of HA sequences therein. There are a variety of methods which can be used to produce libraries of potential HA homologues from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential HA sequences. Methods for synthesizing degenerate oligonucleotides are known in the art (see, e.g., Narang, S. A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477.

In addition, libraries of fragments of the HA protein coding can be used to generate a variegated population of HA fragments for screening and subsequent selection of homologues of an HA protein. In one embodiment, a library of coding sequence fragments can be generated by treating a double stranded PCR fragment of an HA coding sequence with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with SI nuclease, and ligating the resulting fragment library into an expression vector. By this method, an expression library can be derived which encodes N-terminal, C-terminal and internal fragments of various sizes of the HA protein.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of HA homologues. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique which enhances the frequency of functional mutants in the libraries, can be used in combination with the screening assays to identify HA homologues (Arkin and Yourvan (1992) *PNAS* 89:7811–7815; Delgrave et al. (1993) *Protein Engineering* 6(3):327–331).

In another embodiment, cell based assays can be exploited to analyze a variegated HA library, using methods well known in the art.

D. Uses and Methods of the Invention

The nucleic acid molecules, proteins, protein homologues, fusion proteins, primers, vectors, and host cells described herein can be used in one or more of the following methods: identification of *C. glutamicum* and related organisms; mapping of genomes of organisms related to *C. glutamicum*; identification and localization of *C. glutamicum* sequences of interest; evolutionary studies; determination of HA protein regions required for function; modulation of an HA protein activity; modulation of the metabolism of one or more inorganic compounds; modulation of the modification or degradation of one or more aromatic or aliphatic compounds; modulation of cell wall synthesis or rearrangements; modulation of enzyme activity or proteolysis; and modulation of cellular production of a desired compound, such as a fine chemical.

The HA nucleic acid molecules of the invention have a variety of uses. First, they may be used to identify an organism as being *Corynebacterium glutamicum* or a close relative thereof. Also, they may be used to identify the presence of *C. glutamicum* or a relative thereof in a mixed population of microorganisms. The invention provides the nucleic acid sequences of a number of *C. glutamicum* genes; by probing the extracted genomic DNA of a culture of a unique or mixed population of microorganisms under stringent conditions with a probe spanning a region of a *C. glutamicum* gene which is unique to this organism, one can ascertain whether this organism is present. Although *Corynebacterium glutamicum* itself is nonpathogenic, it is related to pathogenic species, such as *Corynebacterium diphtheriae*. *Corynebacterium diphtheriae* is the causative agent of diphtheria, a rapidly developing, acute, febrile infection which involves both local and systemic pathology. In this disease, a local lesion develops in the upper respiratory tract and involves necrotic injury to epithelial cells; the bacilli secrete toxin which is disseminated through this lesion to distal susceptible tissues of the body. Degenerative changes brought about by the inhibition of protein synthesis in these tissues, which include heart, muscle, peripheral nerves, adrenals, kidneys, liver and spleen, result in the systemic pathology of the disease. Diphtheria continues to have high incidence in many parts of the world, including Africa, Asia, Eastern Europe and the independent states of the former Soviet Union. An ongoing epidemic of diphtheria in the latter two regions has resulted in at least 5,000 deaths since 1990.

In one embodiment, the invention provides a method of identifying the presence or activity of *Cornyebacterium diphtheriae* in a subject. This method includes detection of one or more of the nucleic acid or amino acid sequences of the invention (e.g., the sequences set forth in Appendix A or Appendix B) in a subject, thereby detecting the presence or activity of *Corynebacterium diphtheriae* in the subject. *C. glutamicum* and *C. diphtheriae* are related bacteria, and many of the nucleic acid and protein molecules in *C. glutamicum* are homologous to *C. diphtheriae* nucleic acid and protein molecules, and can therefore be used to detect *C. diphtheriae* in a subject.

The nucleic acid and protein molecules of the invention may also serve as markers for specific regions of the genome. This has utility not only in the mapping of the genome, but also for functional studies of *C. glutamicum* proteins. For example, to identify the region of the genome to which a particular *C. glutamicum* DNA-binding protein binds, the *C. glutamicum* genome could be digested, and the fragments incubated with the DNA-binding protein. Those which bind the protein may be additionally probed with the nucleic acid molecules of the invention, preferably with readily detectable labels; binding of such a nucleic acid molecule to the genome fragment enables the localization of the fragment to the genome map of *C. glutamicum*, and, when performed multiple times with different enzymes, facilitates a rapid determination of the nucleic acid sequence to which the protein binds. Further, the nucleic acid molecules of the invention may be sufficiently homologous to the sequences of related species such that these nucleic acid molecules may serve as markers for the construction of a genomic map in related bacteria, such as *Brevibacterium lactofermentum*.

The HA nucleic acid molecules of the invention are also useful for evolutionary and protein structural studies. The processes involved in adaptation and the maintenance of homeostasis in which the molecules of the invention participate are utilized by a wide variety of species; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Manipulation of the HA nucleic acid molecules of the invention may result in the production of HA proteins having functional differences from the wild-type HA proteins. These proteins may be improved in efficiency or activity, may be present in greater numbers in the cell than is usual, or may be decreased in efficiency or activity.

The invention provides methods for screening molecules which modulate the activity of an HA protein, either by interacting with the protein itself or a substrate or binding partner of the HA protein, or by modulating the transcription or translation of an HA nucleic acid molecule of the invention. In such methods, a microorganism expressing one or more HA proteins of the invention is contacted with one or more test compounds, and the effect of each test compound on the activity or level of expression of the HA protein is assessed.

The modulation of activity or number of HA proteins involved in cell wall biosynthesis or rearrangements may impact the production, yield, and/or efficiency of production of one or more fine chemicals from *C. glutamicum* cells. For example, by altering the activity of these proteins, it may be possible to modulate the structure or thickness of the cell wall. The cell wall serves in large measure as a protective device against osmotic lysis and external sources of injury; by modifying the cell wall it may be possible to increase the ability of *C. glutamicum* to withstand the mechanical and shear force stresses encountered by this microorganism during large-scale fermentor culture. Further, each *C. glutamicum* cell is surrounded by a thick cell wall, and thus, a significant portion of the biomass present in large scale culture consists of cell wall. By increasing the rate at which the cell wall is synthesized or by activating cell wall synthesis (through genetic engineering of the HA cell wall proteins of the invention) it may be possible to improve the growth rate of the microorganism. Similarly, by decreasing the activity or number of proteins involved in the degradation of cell wall or by decreasing the repression of cell wall biosynthesis, an overall increase in cell wall production may be achieved. An increase in the number of viable *C. glutamicum* cells (as may be accomplished by any of the foregoing described protein alterations) should result in increased numbers of cells producing the desired fine chemical in large-scale fermentor culture, which should permit increased yields or efficiency of production of these compounds from the culture.

The modulation of activity or number of *C. glutamicum* HA proteins that participate in the modification or degradation of aromatic or aliphatic compounds may also have direct or indirect impacts on the production of one or more fine chemicals from these cells. Certain aromatic or aliphatic modification or degradation products are desirable fine chemicals (e.g., organic acids or modified aromatic and aliphatic compounds); thus, by modifying the enzymes which perform these modifications (e.g., hydroxylation, methylation, or isomerization) or degradation reactions, it may be possible to increase the yields of these desired compounds. Similarly, by decreasing the activity or number of proteins involved in pathways which further degrade the modified or breakdown products of the aforementioned reactions it may be possible to improve the yields of these fine chemicals from *C. glutamicum* cells in culture.

These aromatic and aliphatic modification and degradative enzymes are themselves fine chemicals. In purified form, these enzymes may be used to degrade aromatic and aliphatic compounds (e.g., toxic chemicals such as petroleum products), either for the bioremediation of polluted sites, for the engineered decomposition of wastes, or for the large-scale and economically feasible production of desired modified aromatic or aliphatic compounds or their breakdown products, some of which may be conveniently used as carbon or energy sources for other fine chemical-producing compounds in culture (see, e.g., Faber, K. (1995) Biotransformations in Organic Chemistry, Springer: Berlin and references therein; and Roberts, S. M., ed. (1992–1996) Preparative Biotransformations, Wiley: Chichester, and references therein). By genetically altering these proteins such that their regulation by other cellular mechanisms is lessened or abolished, it may be possible to increase the overall number or activity of these proteins, thereby improving not only the yield of these fine chemicals but also the activity of these harvested proteins.

The modification of these aromatic and aliphatic modifying and degradation enzymes may also have an indirect effect on the production of one or more fine chemical. Many aromatic and aliphatic compounds (such as those that may be encountered as impurities in culture media or as waste products from cellular metabolism) are toxic to cells; by modifying and/or degrading these compounds such that they may be readily removed or destroyed, cellular viability should be increased. Further, these enzymes may modify or degrade these compounds in such a manner that the resulting products may enter the normal carbon metabolism pathways of the cell, thus rendering the cell able to use these compounds as alternate carbon or energy sources. In large-scale culture situations, when there may be limiting amounts of optimal carbon sources, these enzymes provide a method by which cells may continue to grow and divide using aromatic or aliphatic compounds as nutrients. In either case, the resulting increase in the number of *C. glutamicum* cells in the culture producing the desired fine chemical should in turn result in increased yields or efficiency of production of the fine chemical(s).

Modifications in activity or number of HA proteins involved in the metabolism of inorganic compounds may also directly or indirectly affect the production of one or more fine chemicals from *C. gluitamicum* or related bacterial cultures. For example, many desirable fine chemicals, such as nucleic acids, amino acids, cofactors and vitamins (e.g., thiamine, biotin, and lipoic acid) cannot be synthesized without inorganic molecules such as phosphorous, nitrate, sulfate, and iron. The inorganic metabolism proteins of the invention permit the cell to obtain these molecules from a variety of inorganic compounds and to divert them into various fine chemical biosynthetic pathways. Therefore, by increasing the activity or number of enzymes involved in the metabolism of these inorganic compounds, it may be possible to increase the supply of these possibly limiting inorganic molecules, thereby directly increasing the production or efficiency of production of various fine chemicals from *C. glutamicum* cells containing such altered proteins. Modification of the activity or number of inorganic metabolism enzymes of the invention may also render *C. glutamicum* able to better utilize limited inorganic compound supplies, or to utilize nonoptimal inorganic compounds to synthesize amino acids, vitamins, cofactors, or nucleic acids, all of which are necessary for continued growth and replication of the cell. By improving the viability of these cells in large-scale culture, the number of *C. glutamicum* cells producing one or more fine chemicals in the culture may also be increased, in turn increasing the yields or efficiency of production of one or more fine chemicals.

*C. glutamicum* enzymes for general processes are themselves desirable fine chemicals. The specific properties of enzymes (i.e., regio- and stereospecificity, among others) make them useful catalysts for chemical reactions in vitro. Either whole *C. glutamicum* cells may be incubated with an appropriate substrate such that the desired product is produced by enzymes in the cell, or the desired enzymes may be overproduced and purified from *C. glutamicum* cultures (or those of a related bacterium) and subsequently utilized in in vitro reactions in an industrial setting (either in solution or immobilized on a suitable immobile phase). In either situation, the enzyme can either be a natural *C. glutamicum* protein, or it may be mutagenized to have an altered activity; typical industrial uses for such enzymes include as catalysts in the chemical industry (e.g., for synthetic organic chemistry) as food additives, as feed components, for fruit processing, for leather preparation, in detergents, in analysis and medicine, and in the textile industry (see, e.g., Yamada, H. (1993) "Microbial reactions for the production of useful organic compounds," *Chimica* 47: 5–10; Roberts, S. M. (1998) Preparative biotransformations: the employment of enzymes and whole-cells in synthetic chemistry," *J. Chem. Soc. Perkin Trans*. 1: 157–169; Zaks, A. and Dodds, D. R. (1997) "Application of biocatalysis and biotransformations to the synthesis of pharmaceuticals," *DDT* 2: 513–531; Roberts, S. M. and Williamson, N. M. (1997) "The use of enzymes for the preparation of biologically active natural products and analogues in optically active form," *Curr. Organ. Chemistry* 1: 1–20; Faber, K. (1995) Biotransformations in Organic Chemistry, Springer: Berlin; Roberts, S. M., ed. (1992–96) Preparative Biotransformations, Wiley: Chichester; Cheetham, P. S. J. (1995) "The applications of enzymes in industry" in: Handbook of Enzyme Biotechnology, $3^{rd}$ ed., Wiseman, A., ed., Elis: Horwood, p. 419–552; and Ullmann's Encyclopedia of Industrial Chemistry (1987), vol. A9, Enzymes, p. 390–457). Thus, by increasing the activity or number of these enzymes, it may be possible to also increase the ability of the cell to convert supplied substrates to desired products, or to overproduce these enzymes for increased yields in large-scale culture. Further, by mutagenizing these proteins it may be possible to remove feedback inhibition or other repressive cellular regulatory controls such that greater numbers of these enzymes may be produced and activated by the cell, thereby leading to greater yields, production, or efficiency of production of these fine chemical proteins from large-scale cultures. Further, manipulation of these enzymes may alter the activity of one or more *C. glutamicum* metabolic pathways, such as those for the biosynthesis or secretion of one or more fine chemicals.

Mutagenesis of the proteolytic enzymes of the invention such that they are altered in activity or number may also directly or indirectly affect the yield, production, and/or efficiency of production of one or more fine chemicals from *C. glutamicum*. For example, by increasing the activity or number of these proteins, it may be possible to increase the ability of the bacterium to survive in large-scale culture, due to an increased ability of the cell to rapidly degrade proteins misfolded in response to the high temperatures, nonoptimal pH, and other stresses encountered during fermentor culture. Increased numbers of cells in these cultures may result in increased yields or efficiency of production of one or more desired fine chemicals, due to the relatively larger number of cells producing these compounds in the culture. Also, *C. glutamicum* cells possess multiple cell-surface proteases which serve to break down external nutrients into molecules which may be more readily incorporated by the cells as carbon/energy sources or nutrients of other kinds. An increase in activity or number of these enzymes may improve this turnover and increase the levels of available nutrients, thereby improving cell growth or production. Thus, modifications of the proteases of the invention may indirectly impact *C. glutamicum* fine chemical production.

A more direct impact on fine chemical production in response to the modification of one or more of the proteases of the invention may occur when these proteases are involved in the production or degradation of a desired fine chemical. By decreasing the activity of a protease which degrades a fine chemical or a protein involved in the synthesis of a fine chemical it may be possible to increase the levels of that fine chemical (due to the decreased degradation or increased synthesis of the compound). Similarly, by increasing the activity of a protease which degrades a compound to result in a fine chemical or a protein involved in the degradation of a fine chemical, a similar result should be achieved: increased levels of the desired fine chemical from *C. glutamicum* cells containing these engineered proteins.

The aforementioned mutagenesis strategies for HA proteins to result in increased yields of a fine chemical from *C. glutamicum* are not meant to be limiting; variations on these strategies will be readily apparent to one of ordinary skill in the art. Using such strategies, and incorporating the mechanisms disclosed herein, the nucleic acid and protein molecules of the invention may be utilized to generate *C. glutamicum* or related strains of bacteria expressing mutated HA nucleic acid and protein molecules such that the yield, production, and/or efficiency of production of a desired compound is improved. This desired compound may be any product produced by *C. glutamicum*, which includes the final products of biosynthesis pathways and intermediates of naturally-occurring metabolic pathways, as well as molecules which do not naturally occur in the metabolism of *C. glutamicum*, but which are produced by a *C. glutamicum* strain of the invention.

This invention is further illustrated by the following examples which should not be construed as limiting. The contents of all references, patent applications, patents, published patent applications, Tables, Appendices, and the sequence listing cited throughout this application are hereby incorporated by reference.

EXEMPLIFICATION

Example 1

Preparation of Total Genomic DNA of
*Corynebacterium glutamicum* ATCC 13032

A culture of *Corynebacterium glutamicum* (ATCC 13032) was grown overnight at 30° C. with vigorous shaking in BHI medium (Difco). The cells were harvested by centrifugation, the supernatant was discarded and the cells were resuspended in 5 ml buffer-I (5% of the original volume of the culture—all indicated volumes have been calculated for 100 ml of culture volume). Composition of buffer-I: 140.34 g/l sucrose, 2.46 g/l $MgSO_4 \times 7H_2O$, 10 ml/l $KH_2PO_4$ solution (100 g/l, adjusted to pH 6.7 with KOH), 50 ml/l M12 concentrate (10 g/l $(NH_4)_2SO_4$, 1 g/l NaCl, 2 g/l $MgSO_4 \times 7H_2O$, 0.2 g/l $CaCl_2$, 0.5 g/l yeast extract (Difco), 10 ml/l trace-elements-mix (200 mg/l $FeSO_4 \times H_2O$, 10 mg/l $ZnSO_4 \times 7$ $H_2O$, 3 mg/l $MnCl_2 \times 4$ $H_2O$, 30 mg/l $H_3BO_3$ 20 mg/l $CoCl_2 \times 6$ $H_2O$, 1 mg/l $NiCl_2 \times 6$ $H_2O$, 3 mg/l $Na_2MoO_4 \times 2$ $H_2O$, 500 mg/l complexing agent (EDTA or critic acid), 100 m/l vitamins-mix (0.2 mg/l biotin, 0.2 mg/l folic acid, 20 mg/l p-amino benzoic acid, 20 mg/l riboflavin, 40 mg/l ca-panthothenate, 140 mg/l nicotinic acid, 40 mg/l pyridoxole hydrochloride, 200 mg/l myo-inositol). Lysozyme was added to the suspension to a final concentration of 2.5 mg/ml. After an approximately 4 h incubation at 37° C., the cell wall was degraded and the resulting protoplasts are harvested by centrifugation. The pellet was washed once with 5 ml buffer-I and once with 5 ml TE-buffer (10 mM Tris-HCl, 1 mM EDTA, pH 8). The pellet was resuspended in 4 ml TE-buffer and 0.5 ml SDS solution (10%) and 0.5 ml NaCl solution (5 M) are added. After adding of proteinase K to a final concentration of 200 µg/ml, the suspension is incubated for ca. 18 h at 37° C. The DNA was purified by extraction with phenol, phenol-chloroform-isoamylalcohol and chloroform-isoamylalcohol using standard procedures. Then, the DNA was precipitated by adding 1/50 volume of 3 M sodium acetate and 2 volumes of ethanol, followed by a 30 min incubation at −20° C. and a 30 min centrifugation at 12,000 rpm in a high speed centrifuge using a SS34 rotor (Sorvall). The DNA was dissolved in 1 ml TE-buffer containing 20 µg/ml RNaseA and dialysed at 4° C. against 1000 ml TE-buffer for at least 3 hours. During this time, the buffer was exchanged 3 times. To aliquots of 0.4 ml of the dialysed DNA solution, 0.4 ml of 2 M LiCl and 0.8 ml of ethanol are added. After a 30 min incubation at −20° C., the DNA was collected by centrifugation (13,000 rpm, Biofuge Fresco, Heraeus, Hanau, Germany). The DNA pellet was dissolved in TE-buffer. DNA prepared by this procedure could be used for all purposes, including southern blotting or construction of genomic libraries.

Example 2

Construction of Genomic Libraries in *Escherichia coli* of *Corynebacterium glutamicum* ATCC13032

Using DNA prepared as described in Example 1, cosmid and plasmid libraries were constructed according to known and well established methods (see e.g., Sambrook, J. et al. (1989) "Molecular Cloning: A Laboratory Manual", Cold Spring Harbor Laboratory Press, or Ausubel, F. M. et al. (1994) "Current Protocols in Molecular Biology", John Wiley & Sons.)

Any plasmid or cosmid could be used. Of particular use were the plasmids pBR322 (Sutcliffe, J. G. (1979) *Proc. Natl. Acad Sci. USA*, 75:3737–3741); pACYC177 (Change & Cohen (1978) *J. Bacteriol* 134:1141–1156), plasmids of the pBS series (pBSSK+, pBSSK− and others; Stratagene, LaJolla, USA), or cosmids as SuperCos1 (Stratagene, LaJolla, USA) or Lorist6 (Gibson, T. J., Rosenthal A. and Waterson, R. H. (1987) *Gene* 53:283–286. Gene libraries specifically for use in *C. glutamicum* may be constructed using plasmid pSL109 (Lee, H. -S. and A. J. Sinskey (1994) *J. Microbiol. Biotechnol.* 4: 256–263).

Example 3

DNA Sequencing and Computational Functional Analysis

Genomic libraries as described in Example 2 were used for DNA sequencing according to standard methods, in particular by the chain termination method using ABI377 sequencing machines (see e.g., Fleischman, R. D. et al. (1995) "Whole-genome Random Sequencing and Assembly of Haemophilus Influenzae Rd., *Science*, 269:496–512). Sequencing primers with the following nucleotide sequences were used: 5'-GGAAACAGTATGACCATG-3' (SEQ ID NO:441) or 5'-GTAAAACGACGGCCAGT-3' (SEQ ID NO:442).

Example 4

In vivo Mutagenesis

In vivo mutagenesis of *Corynebacterium glutamicum* can be performed by passage of plasmid (or other vector) DNA through *E. coli* or other microorganisms (e.g. Bacillus spp. or yeasts such as *Saccharomyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp, W. D. (1996) DNA repair mechanisms, in: *Escherichia coli* and *Salmonella*, p. 2277–2294, ASM: Washington.) Such strains are well known to those of ordinary skill in the art. The use of such strains is illustrated, for example, in Greener, A. and Callahan, M. (1994) *Strategies* 7: 32–34.

Example 5

DNA Transfer Between *Escherichia coli* and *Corynebacterium glutamicum*

Several *Corynebacterium* and *Brevibacterium* species contain endogenous plasmids (as e.g., pHM1519 or pBL1) which replicate autonomously (for review see, e.g., Martin, J. F. et al. (1987) Biotechnology, 5:137–146). Shuttle vectors for *Escherichia coli* and *Corynebacterium glutamicum* can be readily constructed by using standard vectors for *E. coli* (Sambrook, J. et al. (1989), "Molecular Cloning: A Laboratory Manual", Cold Spring Harbor Laboratory Press or Ausubel, F. M. et al. (1994) "Current Protocols in Molecular Biology", John Wiley & Sons) to which a origin or replication for and a suitable marker from *Corynebacterium glutamicum* is added. Such origins of replication are preferably taken from endogenous plasmids isolated from *Corynebacterium* and *Brevibacterium* species. Of particular use as transformation markers for these species are genes for kanamycin resistance (such as those derived from the Tn5 or Tn903 transposons) or chloramphenicol (Winnacker, E. L. (1987) "From Genes to Clones—Introduction to Gene Technology, VCH, Weinheim). There are numerous examples in the literature of the construction of a wide variety of shuttle vectors which replicate in both *E. coli* and *C. glutamicum*, and which can be used for several purposes, including gene over-expression (for reference, see e.g., Yoshihama, M. et al. (1985) *J. Bacteriol.* 162:591–597, Martin J. F. et al. (1987) *Biotechnology*, 5:137–146 and Eikmanns, B. J. et al. (1991) *Gene*, 102:93–98).

Using standard methods, it is possible to clone a gene of interest into one of the shuttle vectors described above and to introduce such a hybrid vectors into strains of *Corynebacterium glutamicum*. Transformation of *C. glutamicum* can be achieved by protoplast transformation (Kastsumata, R. et al. (1984) *J. Bacteriol.* 159306–311), electroporation (Liebl, E. et al. (1989) *FEMS Microbiol Letters*, 53:399–303) and in cases where special vectors are used, also by conjugation (as described e.g. in Schäfer, A et al. (1990) *J. Bacteriol.* 172:1663–1666). It is also possible to transfer the shuttle vectors for *C. glutamicum* to *E. coli* by preparing plasmid DNA from *C. glutamicum* (using standard methods well-known in the art) and transforming it into *E. coli*. This transformation step can be performed using standard methods, but it is advantageous to use an Mcr-deficient *E. coli* strain, such as NM522 (Gough & Murray (1983) *J. Mol. Biol.* 166:1–19).

Genes may be overexpressed in *C. glutamicum* strains using plasmids which comprise pCG1 (U.S. Pat. No. 4,617, 267) or fragments thereof, and optionally the gene for kanamycin resistance from TN903 (Grindley, N. D. and Joyce, C. M. (1980) *Proc. Natl. Acad Sci. USA* 77(12): 7176–7180). In addition, genes may be overexpressed in *C. glutamicum* strains using plasmid pSL109 (Lee, H. -S. and A. J. Sinskey (1994) *J. Microbiol. Biotechnol.* 4: 256–263).

Aside from the use of replicative plasmids, gene overexpression can also be achieved by integration into the genome. Genomic integration in *C. glutamicum* or other *Corynebacterium* or *Brevibacterium* species may be accomplished by well-known methods, such as homologous recombination with genomic region(s), restriction endonuclease mediated integration (REMI) (see, e.g., DE Patent 19823834), or through the use of transposons. It is also possible to modulate the activity of a gene of interest by modifying the regulatory regions (e.g., a promoter, a repressor, and/or an enhancer) by sequence modification, insertion, or deletion using site-directed methods (such as homologous recombination) or methods based on random events (such as transposon mutagenesis or REMI). Nucleic acid sequences which function as transcriptional terminators may also be inserted 3' to the coding region of one or more genes of the invention; such terminators are well-known in the art and are described, for example, in Winnacker, E. L. (1987) From Genes to Clones—Introduction to Gene Technology. VCH: Weinheim.

Example 6

Assessment of the Expression of the Mutant Protein

Observations of the activity of a mutated protein in a transformed host cell rely on the fact that the mutant protein is expressed in a similar fashion and in a similar quantity to that of the wild-type protein. A useful method to ascertain the level of transcription of the mutant gene (an indicator of the amount of mRNA available for translation to the gene product) is to perform a Northern blot (for reference see, for example, Ausubel et al. (1988) Current Protocols in Molecular Biology, Wiley: New York), in which a primer designed to bind to the gene of interest is labeled with a detectable tag (usually radioactive or chemiluminescent), such that when the total RNA of a culture of the organism is extracted, run on gel, transferred to a stable matrix and incubated with this probe, the binding and quantity of binding of the probe indicates the presence and also the quantity of mRNA for this gene. This information is evidence of the degree of transcription of the mutant gene. Total cellular RNA can be prepared from *Corynebacterium glutamicum* by several methods, all well-known in the art, such as that described in Bormann, E. R. et al. (1992) *Mol. Microbiol.* 6: 317–326.

To assess the presence or relative quantity of protein translated from this mRNA, standard techniques, such as a Western blot, may be employed (see, for example, Ausubel et al. (1988) Current Protocols in Molecular Biology, Wiley: New York). In this process, total cellular proteins are extracted, separated by gel electrophoresis, transferred to a matrix such as nitrocellulose, and incubated with a probe, such as an antibody, which specifically binds to the desired protein. This probe is generally tagged with a chemiluminescent or calorimetric label which may be readily detected. The presence and quantity of label observed indicates the presence and quantity of the desired mutant protein present in the cell.

Example 7

Growth of Genetically Modified *Corynebacterium glutamicum*—Media and Culture Conditions Genetically modified *Corynebacteria* are cultured in synthetic or natural growth media. A number of different growth media for *Corynebacteria* are both well-known and readily available (Lieb et al. (1989) *Appl. Microbiol. Biotechnol.*, 32:205–210; von der Osten et al. (1998) *Biotechnology Letters*, 11:11–16; Patent DE 4,120,867; Liebl (1992) "The Genus *Corynebacterium*, in: The Procaryotes, Volume II, Balows, A. et al., eds. Springer-Verlag). These media consist of one or more carbon sources, nitrogen sources, inorganic salts, vitamins and trace elements. Preferred carbon sources are sugars, such as mono-, di-, or polysaccharides. For example, glucose, fructose, mannose, galactose, ribose, sorbose, ribulose, lactose, maltose, sucrose, raffinose, starch or cellulose serve as very good carbon sources. It is also possible to supply sugar to the media via complex compounds such as molasses or other by-products from sugar refinement. It can also be advantageous to supply mixtures of different carbon sources. Other possible carbon sources are alcohols and organic acids, such as methanol, ethanol, acetic acid or lactic acid. Nitrogen sources are usually organic or inorganic nitrogen compounds, or materials which contain these compounds. Exemplary nitrogen sources include ammonia gas or ammonia salts, such as $NH_4Cl$ or $(NH_4)_2SO_4$, $NH_4OH$, nitrates, urea, amino acids or complex nitrogen sources like corn steep liquor, soy bean flour, soy bean protein, yeast extract, meat extract and others.

Inorganic salt compounds which may be included in the media include the chloride-, phosphorous- or sulfate- salts of calcium, magnesium, sodium, cobalt, molybdenum, potassium, manganese, zinc, copper and iron. Chelating compounds can be added to the medium to keep the metal ions in solution. Particularly useful chelating compounds include dihydroxyphenols, like catechol or protocatechuate, or organic acids, such as citric acid. It is typical for the media to also contain other growth factors, such as vitamins or growth promoters, examples of which include biotin, riboflavin, thiamin, folic acid, nicotinic acid, pantothenate and pyridoxin. Growth factors and salts frequently originate from complex media components such as yeast extract, molasses, corn steep liquor and others. The exact composition of the media compounds depends strongly on the immediate experiment and is individually decided for each specific case. Information about media optimization is available in the textbook "Applied Microbiol. Physiology, A Practical Approach (eds. P. M. Rhodes, P. F. Stanbury, IRL Press (1997) pp. 53–73, ISBN 0 19 963577 3). It is also possible to select growth media from commercial suppliers, like standard 1 (Merck) or BHI (grain heart infusion, DIFCO) or others.

All medium components are sterilized, either by heat (20 minutes at 1.5 bar and 121° C.) or by sterile filtration. The components can either be sterilized together or, if necessary, separately. All media components can be present at the beginning of growth, or they can optionally be added continuously or batchwise.

Culture conditions are defined separately for each experiment. The temperature should be in a range between 15° C. and 45° C. The temperature can be kept constant or can be altered during the experiment. The pH of the medium should be in the range of 5 to 8.5, preferably around 7.0, and can be maintained by the addition of buffers to the media. An exemplary buffer for this purpose is a potassium phosphate buffer. Synthetic buffers such as MOPS, HEPES, ACES and others can alternatively or simultaneously be used. It is also possible to maintain a constant culture pH through the addition of NaOH or $NH_4OH$ during growth. If complex medium components such as yeast extract are utilized, the necessity for additional buffers may be reduced, due to the fact that many complex compounds have high buffer capacities. If a fermentor is utilized for culturing the microorganisms, the pH can also be controlled using gaseous ammonia.

The incubation time is usually in a range from several hours to several days. This time is selected in order to permit the maximal amount of product to accumulate in the broth. The disclosed growth experiments can be carried out in a variety of vessels, such as microtiter plates, glass tubes, glass flasks or glass or metal fermentors of different sizes. For screening a large number of clones, the microorganisms should be cultured in microtiter plates, glass tubes or shake flasks, either with or without baffles. Preferably 100 ml shake flasks are used, filled with 10% (by volume) of the required growth medium. The flasks should be shaken on a rotary shaker (amplitude 25 mm) using a speed-range of 100–300 rpm. Evaporation losses can be diminished by the maintenance of a humid atmosphere; alternatively, a mathematical correction for evaporation losses should be performed.

If genetically modified clones are tested, an unmodified control clone or a control clone containing the basic plasmid without any insert should also be tested. The medium is inoculated to an $OD_{600}$ of 0.5–1.5 using cells grown on agar plates, such as CM plates (10 g/l glucose, 2,5 g/l NaCl, 2 g/l urea, 10 g/l polypeptone, 5 g/l yeast extract, 5 g/l meat extract, 22 g/l NaCl, 2 g/l urea, 10 g/l polypeptone, 5 g/l yeast extract, 5 g/l meat extract, 22 g/l agar, pH 6.8 with 2M NaOH) that had been incubated at 30° C. Inoculation of the media is accomplished by either introduction of a saline suspension of *C. glutamicum* cells from CM plates or addition of a liquid preculture of this bacterium.

Example 8

In vitro Analysis of the Function of Mutant Proteins

The determination of activities and kinetic parameters of enzymes is well established in the art. Experiments to determine the activity of any given altered enzyme must be tailored to the specific activity of the wild-type enzyme, which is well within the ability of one of ordinary skill in the art. Overviews about enzymes in general, as well as specific details concerning structure, kinetics, principles, methods, applications and examples for the determination of many enzyme activities may be found, for example, in the following references: Dixon, M., and Webb, E. C., (1979) Enzymes. Longmans: London; Fersht, (1985) Enzyme Structure and Mechanism. Freeman: New York; Walsh, (1979) Enzymatic Reaction Mechanisms. Freeman: San Francisco; Price, N. C., Stevens, L. (1982) Fundamentals of Enzymology. Oxford Univ. Press: Oxford; Boyer, P. D., ed. (1983) The Enzymes, $3^{rd}$ ed. Academic Press: New York; Bisswanger, H., (1994) Enzymkinetik, $2^{nd}$ ed. VCH: Weinheim (ISBN 3527300325); Bergmeyer, H. U., Bergmeyer, J., Graβ1, M., eds. (1983–1986) Methods of Enzymatic Analysis, $3^{rd}$ ed., vol. I–XII, Verlag Chemie: Weinheim; and Ullmann's Encyclopedia of Industrial Chemistry (1987) vol. A9, "Enzymes". VCH: Weinheim, p. 352–363.

The activity of proteins which bind to DNA can be measured by several well-established methods, such as DNA band-shift assays (also called gel retardation assays). The effect of such proteins on the expression of other molecules can be measured using reporter gene assays (such as that described in Kolmar, H. et al. (1995) *EMBO J.* 14: 3895–3904 and references cited therein). Reporter gene test systems are well known and established for applications in both pro- and eukaryotic cells, using enzymes such as beta-galactosidase, green fluorescent protein, and several others.

The determination of activity of membrane-transport proteins can be performed according to techniques such as those described in Gennis, R. B. (1989) "Pores, Channels and Transporters", in Biomembranes, Molecular Structure and Function, Springer: Heidelberg, p. 85–137; 199–234; and 270–322.

Example 9

Analysis of Impact of Mutant Protein on the Production of the Desired Product

The effect of the genetic modification in *C. glutamicum* on production of a desired compound (such as an amino acid) can be assessed by growing the modified microorganism under suitable conditions (such as those described above) and analyzing the medium and/or the cellular component for increased production of the desired product (i.e., an amino acid). Such analysis techniques are well known to one of ordinary skill in the art, and include spectroscopy, thin layer chromatography, staining methods of various kinds, enzymatic and microbiological methods, and analytical chromatography such as high performance liquid chromatography (see, for example, Ullman, Encyclopedia of Industrial Chemistry, vol. A2, p. 89–90 and p. 443–613, VCH: Weinheim (1985); Fallon, A. et al., (1987) "Applications of HPLC in Biochemistry" in: Laboratory Techniques in Biochemistry and Molecular Biology, vol. 17; Rehm et al. (1993) Biotechnology, vol. 3, Chapter III: "Product recovery and purification", page 469–714, VCH: Weinheim; Belter, P. A. et al. (1988) Bioseparations: downstream processing for biotechnology, John Wiley and Sons; Kennedy, J. F. and Cabral, J. M. S. (1992) Recovery processes for biological materials, John Wiley and Sons; Shaeiwitz, J. A. and Henry, J. D. (1988) Biochemical separations, in: Ulmann's Encyclopedia of Industrial Chemistry, vol. B3, Chapter 11, page 1–27, VCH: Weinheim; and Dechow, F. J. (1989) Separation and purification techniques in biotechnology, Noyes Publications.)

In addition to the measurement of the final product of fermentation, it is also possible to analyze other components of the metabolic pathways utilized for the production of the desired compound, such as intermediates and side-products, to determine the overall efficiency of production of the compound. Analysis methods include measurements of nutrient levels in the medium (e.g., sugars, hydrocarbons, nitrogen sources, phosphate, and other ions), measurements of biomass composition and growth, analysis of the production of common metabolites of biosynthetic pathways, and measurement of gasses produced during fermentation. Standard methods for these measurements are outlined in Applied Microbial Physiology, A Practical Approach, P. M. Rhodes and P. F. Stanbury, eds., IRL Press, p. 103–129; 131–163; and 165–192 (ISBN: 0199635773) and references cited therein.

Example 10

Purification of the Desired Product from *C. glutamicum* Culture

Recovery of the desired product from the *C. glutamicum* cells or supernatant of the above-described culture can be performed by various methods well known in the art. If the desired product is not secreted from the cells, the cells can be harvested from the culture by low-speed centrifugation, the cells can be lysed by standard techniques, such as mechanical force or sonication. The cellular debris is removed by centrifugation, and the supernatant fraction containing the soluble proteins is retained for further purification of the desired compound. If the product is secreted from the *C. glutamicum* cells, then the cells are removed from the culture by low-speed centrifugation, and the supernate fraction is retained for further purification.

The supernatant fraction from either purification method is subjected to chromatography with a suitable resin, in which the desired molecule is either retained on a chromatography resin while many of the impurities in the sample are not, or where the impurities are retained by the resin while the sample is not. Such chromatography steps may be repeated as necessary, using the same or different chromatography resins. One of ordinary skill in the art would be well-versed in the selection of appropriate chromatography resins and in their most efficacious application for a particular molecule to be purified. The purified product may be concentrated by filtration or ultrafiltration, and stored at a temperature at which the stability of the product is maximized.

There are a wide array of purification methods known to the art and the preceding method of purification is not meant to be limiting. Such purification techniques are described, for example, in Bailey, J. E. & Ollis, D. F. Biochemical Engineering Fundamentals, McGraw-Hill: New York (1986).

The identity and purity of the isolated compounds may be assessed by techniques standard in the art. These include high-performance liquid chromatography (HPLC), spectroscopic methods, staining methods, thin layer chromatography, NIRS, enzymatic assay, or microbiologically. Such analysis methods are reviewed in: Patek et al. (1994) *Apple. Environ. Microbiol.* 60: 133–140; Malakhova et al. (1996) *Biotekhnologiya* 11: 27–32; and Schmidt et al. (1998) *Bioprocess Engineer.* 19: 67–70. Ulmann's Encyclopedia of Industrial Chemistry, (1996) vol. A27, VCH: Weinheim, p. 89–90, p. 521–540, p. 540–547, p. 559–566, 575–581 and p. 581–587; Michal, G. (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Example 11

Analysis of the Gene Sequences of the Invention

The comparison of sequences and determination of percent homology between two sequences are art-known techniques, and can be accomplished using a mathematical algorithm, such as the algorithm of Karlin and Altschul (1990) *Proc. Natl. Acad. Sci. USA* 87:2264–68, modified as in Karlin and Altschul (1993) *Proc. Natl. Acad Sci. USA* 90:5873–77. Such an algorithm is incorporated into the NBLAST and XBLAST programs (version 2.0) of Altschul, et al. (1990) *J. Mol. Biol.* 215:403–10. BLAST nucleotide searches can be performed with the NBLAST program, score=100, wordlength=12 to obtain nucleotide sequences homologous to HA nucleic acid molecules of the invention. BLAST protein searches can be performed with the XBLAST program, score=50, wordlength=3 to obtain amino acid sequences homologous to HA protein molecules of the invention. To obtain gapped alignments for comparison purposes, Gapped BLAST can be utilized as described in Altschul et al., (1997) *Nucleic Acids Res.* 25(17):3389–3402. When utilizing BLAST and Gapped BLAST programs, one of ordinary skill in the art will know how to optimize the parameters of the program (e.g., XBLAST and NBLAST) for the specific sequence being analyzed.

Another example of a mathematical algorithm utilized for the comparison of sequences is the algorithm of Meyers and Miller ((1988) *Comput. Appl. Biosci.* 4: 11–17). Such an algorithm is incorporated into the ALIGN program (version 2.0) which is part of the GCG sequence alignment software package. When utilizing the ALIGN program for comparing amino acid sequences, a PAM 120 weight residue table, a gap length penalty of 12, and a gap penalty of 4 can be used. Additional algorithms for sequence analysis are known in the art, and include ADVANCE and ADAM. described in Torelli and Robotti (1994) *Comput. Appl. Biosci.* 10:3–5; and FASTA, described in Pearson and Lipman (1988) *P.N.A.S.* 85:2444–8.

The percent homology between two amino acid sequences can also be accomplished using the GAP program in the GCG software package (available at http://www.gcg.com), using either a Blosum 62 matrix or a PAM250 matrix, and a gap weight of 12, 10, 8, 6, or 4 and a length weight of 2, 3, or 4. The percent homology between two nucleic acid sequences can be accomplished using the GAP program in the GCG software package, using standard parameters, such as a gap weight of 50 and a length weight of 3.

A comparative analysis of the gene sequences of the invention with those present in Genbank has been performed using techniques known in the art (see, e.g., Bexevanis and Ouellette, eds. (1998) Bioinformatics: A Practical Guide to the Analysis of Genes and Proteins. John Wiley and Sons: New York). The gene sequences of the invention were compared to genes present in Genbank in a three-step process. In a first step, a BLASTN analysis (e.g., a local alignment analysis) was performed for each of the sequences of the invention against the nucleotide sequences present in Genbank, and the top 500 hits were retained for further analysis. A subsequent FASTA search (e.g., a combined local and global alignment analysis, in which limited regions of the sequences are aligned) was performed on these 500 hits. Each gene sequence of the invention was subsequently globally aligned to each of the top three FASTA hits, using the GAP program in the GCG software package (using standard parameters). In order to obtain correct results, the length of the sequences extracted from Genbank were adjusted to the length of the query sequences by methods well-known in the art. The results of this analysis are set forth in Table 4. The resulting data is identical to that which would have been obtained had a GAP (global) analysis alone been performed on each of the genes of the invention in comparison with each of the references in Genbank, but required significantly reduced computational time as compared to such a database-wide GAP (global) analysis. Sequences of the invention for which no alignments above the cutoff values were obtained are indicated on Table 4 by the absence of alignment information. It will further be understood by one of ordinary skill in the art that the GAP alignment homology percentages set forth in Table 4 under the heading "% homology (GAP)" are listed in the European numerical format, wherein a ',' represents a decimal point. For example, a value of "40,345" in this column represents "40.345%".

Example 12

Construction and Operation of DNA Microarrays

The sequences of the invention may additionally be used in the construction and application of DNA microarrays (the design, methodology, and uses of DNA arrays are well known in the art, and are described, for example, in Schena, M. et al. (1995) *Science* 270: 467–470; Wodicka, L. et al. (1997) *Nature Biotechnology* 15: 1359–1367; DeSaizieu, A. et al. (1998) *Nature Biotechnology* 16: 45–48; and DeRisi, J. L. et al. (1997) *Science* 278: 680–686).

DNA microarrays are solid or flexible supports consisting of nitrocellulose, nylon, glass, silicone, or other materials. Nucleic acid molecules may be attached to the surface in an ordered manner. After appropriate labeling, other nucleic acids or nucleic acid mixtures can be hybridized to the immobilized nucleic acid molecules, and the label may be used to monitor and measure the individual signal intensities of the hybridized molecules at defined regions. This methodology allows the simultaneous quantification of the relative or absolute amount of all or selected nucleic acids in the applied nucleic acid sample or mixture. DNA microarrays, therefore, permit an analysis of the expression of multiple (as many as 6800 or more) nucleic acids in parallel (see, e.g., Schena, M. (1996) *BioEssays* 18(5): 427–431).

The sequences of the invention may be used to design oligonucleotide primers which are able to amplify defined regions of one or more *C. glutamicum* genes by a nucleic acid amplification reaction such as the polymerase chain reaction. The choice and design of the 5' or 3' oligonucleotide primers or of appropriate linkers allows the covalent attachment of the resulting PCR products to the surface of a support medium described above (and also described, for example, Schena, M. et al. (1995) *Science* 270: 467–470).

Nucleic acid microarrays may also be constructed by in situ oligonucleotide synthesis as described by Wodicka, L. et al. (1997) *Nature Biotechnology* 15: 1359–1367. By photolithographic methods, precisely defined regions of the matrix are exposed to light. Protective groups which are photolabile are thereby activated and undergo nucleotide addition, whereas regions that are masked from light do not undergo any modification. Subsequent cycles of protection and light activation permit the synthesis of different oligonucleotides at defined positions. Small, defined regions of the genes of the invention may be synthesized on microarrays by solid phase oligonucleotide synthesis.

The nucleic acid molecules of the invention present in a sample or mixture of nucleotides may be hybridized to the microarrays. These nucleic acid molecules can be labeled according to standard methods. In brief, nucleic acid molecules (e.g., mRNA molecules or DNA molecules) are labeled by the incorporation of isotopically or fluorescently labeled nucleotides, e.g., during reverse transcription or DNA synthesis. Hybridization of labeled nucleic acids to microarrays is described (e.g., in Schena, M. et al. (1995) supra; Wodicka, L. et al. (1997), supra; and DeSaizieu A. et al. (1998), supra). The detection and quantification of the hybridized molecule are tailored to the specific incorporated label. Radioactive labels can be detected, for example, as described in Schena, M. et al. (1995) supra) and fluorescent labels may be detected, for example, by the method of Shalon et al. (1996) *Genome Research* 6: 639–645).

The application of the sequences of the invention to DNA microarray technology, as described above, permits comparative analyses of different strains of *C. glutamicum* or other *Corynebacteria*. For example, studies of inter-strain variations based on individual transcript profiles and the identification of genes that are important for specific and/or desired strain properties such as pathogenicity, productivity and stress tolerance are facilitated by nucleic acid array methodologies. Also, comparisons of the profile of expression of genes of the invention during the course of a fermentation reaction are possible using nucleic acid array technology.

Example 13

Analysis of the Dynamics of Cellular Protein Populations (Proteomics)

The genes, compositions, and methods of the invention may be applied to study the interactions and dynamics of populations of proteins, termed 'proteomics'. Protein populations of interest include, but are not limited to, the total protein population of *C. glutamicum* (e.g., in comparison with the protein populations of other organisms), those proteins which are active under specific environmental or metabolic conditions (e.g., during fermentation, at high or low temperature, or at high or low pH), or those proteins which are active during specific phases of growth and development.

Protein populations can be analyzed by various well-known techniques, such as gel electrophoresis. Cellular proteins may be obtained, for example, by lysis or extraction, and may be separated from one another using a variety of electrophoretic techniques. Sodium dodecyl sulfate polyacrylamide gel electrophoresis (SDS-PAGE) separates proteins largely on the basis of their molecular weight. Isoelectric focusing polyacrylamide gel electrophoresis (IEF-PAGE) separates proteins by their isoelectric point (which reflects not only the amino acid sequence but also posttranslational modifications of the protein). Another, more preferred method of protein analysis is the consecutive combination of both IEF-PAGE and SDS-PAGE, known as 2-D-gel electrophoresis (described, for example, in Hermann et al. (1998) *Electrophoresis* 19: 3217–3221; Fountoulakis et al. (1998) *Electrophoresis* 19: 1193–1202; Langen et al. (1997) *Electrophoresis* 18: 1184–1192; Antelmann et al. (1997) *Electrophoresis* 18: 1451–1463). Other separation techniques may also be utilized for protein separation, such as capillary gel electrophoresis; such techniques are well known in the art.

Proteins separated by these methodologies can be visualized by standard techniques, such as by staining or labeling. Suitable stains are known in the art, and include Coomassie Brilliant Blue, silver stain, or fluorescent dyes such as Sypro Ruby (Molecular Probes). The inclusion of radioactively labeled amino acids or other protein precursors (e.g., $^{35}$S-methionine, $^{35}$S-cysteine, $^{14}$C-labelled amino acids, $^{15}$N-amino acids, $^{15}$NO$_3$ or $^{15}$NH$_4$+ or $^{13}$C-labelled amino acids) in the medium of *C. glutamicum* permits the labeling of proteins from these cells prior to their separation. Similarly, fluorescent labels may be employed. These labeled proteins can be extracted, isolated and separated according to the previously described techniques.

Proteins visualized by these techniques can be further analyzed by measuring the amount of dye or label used. The amount of a given protein can be determined quantitatively using, for example, optical methods and can be compared to the amount of other proteins in the same gel or in other gels. Comparisons of proteins on gels can be made, for example, by optical comparison, by spectroscopy, by image scanning and analysis of gels, or through the use of photographic films and screens. Such techniques are well-known in the art.

To determine the identity of any given protein, direct sequencing or other standard techniques may be employed. For example, N- and/or C-terminal amino acid sequencing (such as Edman degradation) may be used, as may mass spectrometry (in particular MALDI or ESI techniques (see, e.g., Langen et al. (1997) *Electrophoresis* 18: 1184–1192)). The protein sequences provided herein can be used for the identification of *C. glutamicum* proteins by these techniques.

The information obtained by these methods can be used to compare patterns of protein presence, activity, or modification between different samples from various biological conditions (e.g., different organisms, time points of fermentation, media conditions, or different biotopes, among others). Data obtained from such experiments alone, or in combination with other techniques, can be used for various applications, such as to compare the behavior of various organisms in a given (e.g., metabolic) situation, to increase the productivity of strains which produce fine chemicals or to increase the efficiency of the production of fine chemicals.

Equivalents

Those of ordinary skill in the art will recognize, or will be able to ascertain using no more than routine experimentation, many equivalents to the specific embodiments of the invention described herein. Such equivalents are intended to be encompassed by the following claims.

TABLE 1

Genes in the Application

| Nucleic Acid SEQ ID NO | Amino Acid SEQ ID NO | Identification Code | Contig. | NT Start | NT Stop | Function |
|---|---|---|---|---|---|---|
| 1 | 2 | RXA02548 | GR00727 | 3 | 293 | SULFATE ADENYLATE TRANSFERASE SUBUNIT 2 (EC 2.7.7.4) |
| 3 | 4 | RXN00249 | VV0057 | 36825 | 35869 | ADENYLYLSULFATE KINASE (EC 2.7.1.25) |
| 5 | 6 | F RXA00249 | GR00037 | 8837 | 7884 | ADENYLYLSULFATE KINASE (EC 2.7.1.25) |
| 7 | 8 | RXA01073 | GR00300 | 1274 | 2104 | NH(3)-DEPENDENT NAD(+) SYNTHETASE (EC 6.3.5.1) |
| | | | | | | Urease |
| 9 | 10 | RXN02913 | VV0020 | 8998 | 8513 | UREASE BETA SUBUNIT (EC 3.5.1.5) |
| 11 | 12 | F RXA02264 | GR00655 | 123 | 4 | UREASE ALPHA SUBUNIT (EC 3.5.1.5) |
| 13 | 14 | RXN02274 | VV0020 | 8509 | 6800 | UREASE ALPHA SUBUNIT (EC 3.5.1.5) |
| 15 | 16 | F RXA02274 | GR00656 | 3 | 1604 | UREASE ALPHA SUBUNIT (EC 3.5.1.5) |
| 17 | 18 | RXA02265 | GR00655 | 452 | 153 | UREASE GAMMA SUBUNIT (EC 3.5.1.5) |
| 19 | 20 | RXA02278 | GR00656 | 3420 | 4268 | UREASE OPERON URED PROTEIN |
| 21 | 22 | RXA02275 | GR00656 | 1632 | 2102 | UREASE ACCESSORY PROTEIN UREE |
| 23 | 24 | RXA02276 | GR00656 | 2105 | 2782 | UREASE ACCESSORY PROTEIN UREF |
| 25 | 26 | RXA02277 | GR00656 | 2802 | 3416 | UREASE ACCESSORY PROTEIN UREG |
| 27 | 28 | RXA02603 | GR00742 | 7742 | 8737 | 4-HYDROXYBENZOATE OCTAPRENYLTRANSFERASE (EC 2.5.1.—) |
| 29 | 30 | RXA01385 | GR00406 | 5320 | 3440 | PHENOL 2 MONOOXYGENASE (EC 1.14.13.7) |
| | | | | | | Proteolysis |
| 31 | 32 | RXN00675 | VV0005 | 33258 | 34049 | METHIONINE AMINOPEPTIDASE (EC 3.4.11.18) |
| 33 | 34 | F RXA00675 | GR00178 | 2 | 484 | METHIONINE AMINOPEPTIDASE (EC 3.4.11.18) |
| 35 | 36 | RXA01609 | GR00449 | 2740 | 3612 | METHIONINE AMINOPEPTIDASE (EC 3.4.11.18) |
| 37 | 38 | RXA01358 | GR00393 | 5337 | 6857 | ATP-DEPENDENT PROTEASE LA (EC 3.4.21.53) |
| 39 | 40 | RXA01458 | GR00420 | 3225 | 2176 | ATP-DEPENDENT PROTEASE LA (EC 3.4.21.53) |
| 41 | 42 | RXA01654 | GR00459 | 986 | 1981 | (AL022121) putative alkaline serine protease [*Mycobacterium tuberculosis*] |
| 43 | 44 | RXN01868 | VV0127 | 9980 | 11905 | ZINC METALLOPROTEASE (EC 3.4.24.—) |
| 45 | 46 | F RXA01868 | GR00534 | 1640 | 30 | ZINC METALLOPROTEASE (EC 3.4.24.—) |
| 47 | 48 | F RXA01869 | GR00534 | 1954 | 1652 | ZINC METALLOPROTEASE (EC 3.4.24.—) |
| 49 | 50 | RXN03028 | VV0008 | 41156 | 43930 | ATP-DEPENDENT CLP PROTEASE ATP-BINDING SUBUNIT CLPA |
| 51 | 52 | F RXA02470 | GR00715 | 2216 | 3196 | ATP-DEPENDENT CLP PROTEASE ATP-BINDING SUBUNIT CLPA |
| 53 | 54 | F RXA02471 | GR00715 | 3159 | 4991 | ATP-DEPENDENT CLP PROTEASE ATP-BINDING SUBUNIT CLPA |
| 55 | 56 | RXA02630 | GR00748 | 2654 | 1332 | (AL021999) putative serine protease [*Mycobacterium tuberculosis*] |
| 57 | 58 | RXA02834 | GR00823 | 3 | 497 | ATPases with chaperone activity, ATP-dependent protease subunit |
| 59 | 60 | RXA00112 | GR00016 | 3687 | 2497 | PROBABLE PERIPLASMIC SERINE PROTEASE DO-LIKE PRECURSOR |
| 61 | 62 | RXA00566 | GR00152 | 742 | 137 | ATP-DEPENDENT CLP PROTEASE PROTEOLYTIC SUBUNIT (EC 3.4.21.92) |
| 63 | 64 | RXA00567 | GR00152 | 1388 | 798 | ATP-DEPENDENT CLP PROTEASE PROTEOLYTIC SUBUNIT (EC 3.4.21.92) |
| 65 | 66 | RXN03094 | VV0057 | 1794 | 43 | CLPB PROTEIN |
| 67 | 68 | F RXA01668 | GR00464 | 2205 | 3920 | CLPB PROTEIN |
| 69 | 70 | RXN01120 | VV0182 | 5678 | 4401 | ATP-DEPENDENT CLP PROTEASE ATP-BINDING SUBUNIT CLPX |
| 71 | 72 | F RXA01120 | GR00310 | 2349 | 1072 | ATP-DEPENDENT CLP PROTEASE ATP-BINDING SUBUNIT CLPX |
| 73 | 74 | RXA00744 | GR00202 | 10722 | 9781 | Periplasmic serine proteases |
| 75 | 76 | RXA00844 | GR00228 | 3620 | 4453 | Hypothetical Secretory Serine Protease (EC 3.4.21.—) |
| 77 | 78 | RXA01151 | GR00324 | 862 | 5 | ATP-dependent Zn proteases |
| 79 | 80 | RXA02317 | GR00665 | 9664 | 9053 | PEPTIDASE E (EC 3.4.—.—) |
| 81 | 82 | RXA02644 | GR00751 | 767 | 117 | XAA-PRO DIPEPTIDASE (EC 3.4.13.9) |
| 83 | 84 | RXN02820 | VV0131 | 4799 | 6109 | GAMMA-GLUTAMYLTRANSPEPTIDASE (EC 2.3.2.2) |
| 85 | 86 | F RXA02820 | GR00801 | 1 | 507 | GAMMA-GLUTAMYLTRANSPEPTIDASE (EC 2.3.2.2) |
| 87 | 88 | F RXA02000 | GR00589 | 3430 | 3933 | GAMMA-GLUTAMYLTRANSPEPTIDASE (EC 2.3.2.2) |
| 89 | 90 | RXN03178 | VV0334 | 921 | 121 | PENICILLIN-BINDING PROTEIN 5* PRECURSOR (D-ALANYL-D-ALANINE CARBOXYPEPTIDASE) (EC 3.4.16.4) |
| 91 | 92 | F RXA02859 | GR10005 | 846 | 121 | PENICILLIN-BINDING PROTEIN 5* PRECURSOR (D-ALANYL-D-ALANINE CARBOXYPEPTIDASE) (EC 3.4.16.4) |
| 93 | 94 | RXA00137 | GR00022 | 738 | 1826 | XAA-PRO AMINOPEPTIDASE (EC 3.4.11.9) |

TABLE 1-continued

Genes in the Application

| Nucleic Acid SEQ ID NO | Amino Acid SEQ ID NO | Identification Code | Contig. | NT Start | NT Stop | Function |
|---|---|---|---|---|---|---|
| 95 | 96 | RXN00499 | VV0086 | 8158 | 9438 | PROLINE IMINOPEPTIDASE (EC 3.4.11.5) |
| 97 | 98 | F RXA00499 | GR00125 | 3 | 959 | PROLINE IMINOPEPTIDASE |
| 99 | 100 | RXN00877 | VV0099 | 2221 | 3885 | PEPTIDYL-DIPEPTIDASE DCP (EC 3.4.15.5) |
| 101 | 102 | F RXA00877 | GR00242 | 3 | 1067 | PEPTIDYL-DIPEPTIDASE DCP (EC 3.4.15.5) |
| 103 | 104 | RXN01014 | VV0209 | 13328 | 10728 | AMINOPEPTIDASE N (EC 3.4.11.2) |
| 105 | 106 | F RXA01014 | GR00289 | 3 | 1580 | AMINOPEPTIDASE N (EC 3.4.11.2) |
| 107 | 108 | F RXA01018 | GR00290 | 2289 | 3152 | AMINOPEPTIDASE N (EC 3.4.11.2) |
| 109 | 110 | RXA01147 | GR00323 | 1353 | 94 | VACUOLAR AMINOPEPTIDASE I PRECURSOR (EC 3.4.11.1) |
| 111 | 112 | RXA01161 | GR00329 | 1253 | 117 | XAA-PRO AMINOPEPTIDASE (EC 3.4.11.9) |
| 113 | 114 | RXN01181 | VV0065 | 1 | 957 | AMINOPEPTIDASE A/I (EC 3.4.11.1) |
| 115 | 116 | F RXA01181 | GR00337 | 1 | 957 | AMINOPEPTIDASE |
| 117 | 118 | RXN01277 | VV0009 | 32155 | 34158 | PROLYL ENDOPEPTIDASE (EC 3.4.21.26) |
| 119 | 120 | F RXA01277 | GR00368 | 1738 | 50 | PROLYL ENDOPEPTIDASE (EC 3.4.21.26) |
| 121 | 122 | RXA01914 | GR00548 | 125 | 550 | AMINOPEPTIDASE |
| 123 | 124 | RXA02048 | GR00624 | 207 | 1580 | AMINOPEPTIDASE N (EC 3.4.11.2) |
| 125 | 126 | RXN00621 | VV0135 | 5853 | 5071 | PROTEASE II (EC 3.4.21.83) |
| 127 | 128 | F RXA00621 | GR00163 | 4075 | 4857 | PTRB periplasmic protease |
| 129 | 130 | RXN00622 | VV0135 | 5150 | 3735 | PROTEASE II (EC 3.4.21.83) |
| 131 | 132 | F RXA00622 | GR00163 | 4778 | 6193 | PTRB periplasmic protease |
| 133 | 134 | RXN00982 | VV0149 | 7596 | 6091 | (L42758) proteinase [*Streptomyces lividans*] |
| 135 | 136 | F RXA00977 | GR00275 | 1647 | 2660 | (L42758) proteinase [*Streptomyces lividans*] |
| 137 | 138 | F RXA00982 | GR00276 | 5194 | 4949 | (L42758) proteinase [*Streptomyces lividans*] |
| 139 | 140 | RXA00152 | GR00023 | 7175 | 5880 | HFLC PROTEIN (EC 3.4.—.—) |
| 141 | 142 | RXA02558 | GR00731 | 4939 | 3965 | HFLC PROTEIN (EC 3.4.—.—) |
| 143 | 144 | RXA00500 | GR00125 | 969 | 1643 | O-SIALOGLYCOPROTEIN ENDOPEPTIDASE (EC 3.4.24.57) |
| 145 | 146 | RXA00501 | GR00125 | 1643 | 2149 | O-SIALOGLYCOPROTEIN ENDOPEPTIDASE (EC 3.4.24.57) |
| 147 | 148 | RXA00502 | GR00125 | 2156 | 3187 | O-SIALOGLYCOPROTEIN ENDOPEPTIDASE (EC 3.4.24.57) |

Enzymes in general

| | | | | | | |
|---|---|---|---|---|---|---|
| 149 | 150 | RXN02589 | VV0098 | 16346 | 17110 | Hypothetical Methyltransferase (EC 2.1.1.—) |
| 151 | 152 | F RXA02589 | GR00741 | 13804 | 13040 | Predicted S-adenosylmethionine-dependent methyltransferase |
| 153 | 154 | RXA00226 | GR00032 | 26836 | 26012 | SAM-dependent methyltransferases |
| 155 | 156 | RXN01885 | VV0184 | 2004 | 2804 | Hypothetical Methyltransferase (EC 2.1.1-) |
| 157 | 158 | F RXA01885 | GR00539 | 1589 | 2389 | SAM-dependent methyltransferases |
| 159 | 160 | RXA02592 | GR00741 | 18477 | 17707 | SAM-dependent methyltransferases |
| 161 | 162 | RXN01795 | VV0093 | 722 | 1318 | MODIFIKATION METHYLASE (EC 2.1.1.73) |
| 163 | 164 | F RXA01795 | GR00507 | 706 | 1140 | MODIFICATION METHYLASE (EC 2.1.1.73) |
| 165 | 166 | RXA01214 | GR00351 | 1640 | 3130 | LACCASE 1 PRECURSOR (EC 1.10.3.2) |
| 167 | 168 | RXA01250 | GR00364 | 592 | 5 | LACCASE 1 PRECURSOR (EC 1.10.3.2) |
| 169 | 170 | RXA02477 | GR00715 | 10581 | 11201 | CARBONIC ANHYDRASE (EC 4.2.1.1) |
| 171 | 172 | RXN00833 | GR00225 | 374 | 6 | THIOL PEROXIDASE (EC 1.11.1.—) |
| 173 | 174 | F RXA00833 | GR00225 | 374 | 6 | THIOL PEROXIDASE (EC 1.11.1.—) |
| 175 | 176 | RXA01224 | GR00354 | 4186 | 5208 | 2-NITROPROPANE DIOXYGENASE (EC 1.13.11.32) |
| 177 | 178 | RXA01182 | GR00337 | 1363 | 971 | Hypothetical Oxidoreductase |
| 179 | 180 | RXA02531 | GR00726 | 1226 | 1936 | Hypothetical Oxidoreductase |
| 181 | 182 | RXN00689 | VV0005 | 22416 | 20926 | BETAINE-ALDEHYDE DEHYDROGENASE PRECURSOR (EC 1.2.1.8) |
| 183 | 184 | F RXA00689 | GR00180 | 1401 | 775 | BETAINE-ALDEHYDE DEHYDROGENASE PRECURSOR (EC 1.2.1.8) |
| 185 | 186 | RXN03128 | VV0120 | 3 | 857 | MORPHINE 6-DEHYDROGENASE (EC 1.1.1.218) |
| 187 | 188 | F RXA02192 | GR00643 | 2 | 523 | MORPHINE 6-DEHYDROGENASE (EC 1.1.1.218) |
| 189 | 190 | RXA02351 | GR00679 | 132 | 1070 | NITRILOTRIACETATE MONOOXYGENASE COMPONENT A (EC 1.14.13.—) |
| 191 | 192 | RXN00905 | VV0238 | 8075 | 8875 | N-ACYL-L-AMINO ACID AMIDOHYDROLASE (EC 3.5.1.14) |
| 193 | 194 | F RXA00905 | GR00247 | 2 | 694 | N-ACYL-L-AMINO ACID AMIDOHYDROLASE (EC 3.5.1.14) |
| 195 | 196 | RXA00906 | GR00247 | 630 | 1133 | N-ACYL-L-AMINO ACID AMIDOHYDROLASE (EC 3.5.1.14) |
| 197 | 198 | RXA00907 | GR00247 | 1143 | 1265 | N-ACYL-L-AMINO ACID AMIDOHYDROLASE (EC 3.5.1.14) |
| 199 | 200 | RXA02101 | GR00631 | 3104 | 1842 | N-ACYL-L-AMINO ACID AMIDOHYDROLASE (EC 3.5.1.14) |
| 201 | 202 | RXN02565 | VV0154 | 14299 | 13034 | N-ACYL-L-AMINO ACID AMIDOHYDROLASE (EC 3.5.1.14) |
| 203 | 204 | F RXA02565 | GR00733 | 1 | 342 | N-ACYL-L-AMINO ACID AMIDOHYDROLASE (EC 3.5.1.14) |
| 205 | 206 | F RXA02567 | GR00734 | 3 | 740 | N-ACYL-L-AMINO ACID AMIDOHYDROLASE (EC 3.5.1.14) |
| 207 | 208 | RXN03077 | VV0043 | 1729 | 2913 | N-ACYL-L-AMINO ACID AMIDOHYDROLASE (EC 3.5.1.14) |
| 209 | 210 | F RXA02855 | GR10002 | 1693 | 2877 | N-ACYL-L-AMINO ACID AMIDOHYDROLASE (EC 3.5.1.14), hippurate hydrolase |
| 211 | 212 | RXA00026 | GR00003 | 3657 | 5042 | Hypothetical Amidohydrolase (EC 3.5.1.—) |
| 213 | 214 | RXA01971 | GR00569 | 963 | 133 | Hypothetical Metal-Dependent Hydrolase |
| 215 | 216 | RXA01802 | GR00509 | 3461 | 4291 | Predicted hydrolases (HAD superfamily) |
| 217 | 218 | RXN00866 | VV0258 | 3557 | 4522 | Predicted Zn-dependent hydrolases |
| 219 | 220 | F RXA00866 | GR00236 | 3555 | 4499 | Predicted Zn-dependent hydrolases |
| 221 | 222 | RXA02410 | GR00703 | 792 | 127 | Predicted Zn-dependent hydrolases |
| 223 | 224 | RXA00961 | GR00267 | 2 | 433 | SALICYLATE HYDROXYLASE (EC 1.14.13.1) |
| 225 | 226 | RXA00111 | GR00016 | 930 | 1922 | SOLUBLE EPOXIDE HYDROLASE (SEH) (EC 3.3.2.3) |
| 227 | 228 | RXA01932 | GR00555 | 6479 | 5583 | ACETYL-HYDROLASE (EC 3.1.1.—) |
| 229 | 230 | RXA02574 | GR00739 | 833 | 1840 | PUTATIVE SECRETED HYDROLASE |

TABLE 1-continued

Genes in the Application

| Nucleic Acid SEQ ID NO | Amino Acid SEQ ID NO | Identification Code | Contig. | NT Start | NT Stop | Function |
|---|---|---|---|---|---|---|
| 231 | 232 | RXN00983 | VV0231 | 1796 | 321 | SIALIDASE PRECURSOR (EC 3.2.1.18) |
| 233 | 234 | F RXA00983 | GR00278 | 1200 | 4 | SIALIDASE PRECURSOR (EC 3.2.1.18) |
| 235 | 236 | RXA00984 | GR00278 | 1716 | 1300 | SIALIDASE PRECURSOR (EC 3.2.1.18) |
| 237 | 238 | RXN02513 | VV0193 | 737 | 6 | SIALIDASE PRECURSOR (EC 3.2.1.18) |
| 239 | 240 | F RXA02513 | GR00722 | 93 | 824 | SIALIDASE PRECURSOR (EC 3.2.1.18) |
| 241 | 242 | RXA00903 | GR00246 | 637 | 5 | Putative epimerase |
| 243 | 244 | RXA01224 | GR00354 | 4186 | 5208 | 2-NITROPROPANE DIOXYGENASE (EC 1.13.11.32) |
| 245 | 246 | RXA01571 | GR00438 | 1360 | 1959 | ALCOHOL DEHYDROGENASE (EC 1.1.1.1) |
| 247 | 248 | RXN02478 | VV0119 | 7564 | 6350 | SIALIDASE PRECURSOR (EC 3.2.1.18) |
| 249 | 250 | RXN00343 | VV0125 | 1118 | 6 | 3-OXOSTEROID 1-DEHYDROGENASE (EC 1.3.99.4) |
| 251 | 252 | RXN01555 | VV0135 | 29820 | 28861 | 3-OXOSTEROIO 1-DEHYDROGENASE (EC 1.3.99.4) |
| 253 | 254 | RXN01166 | VV0117 | 18142 | 16838 | EXTRACELLULAR LIPASE PRECURSOR (EC 3.1.1.3) |
| 255 | 256 | RXN02001 | VV0326 | 630 | 1787 | N-ACYL-L-AMINO ACID AMIDOHYDROLASE (EC 3.5.1.14) |
| 257 | 258 | RXN03145 | VV0142 | 7561 | 7115 | 4-OXALOCROTONATE TAUTOMERASE (EC 5.3.2.—) |
| 259 | 260 | RXN01466 | VV0019 | 7050 | 6091 | ARYLESTERASE (EC 3.1.1.2) |
| 261 | 262 | RXN01145 | VV0077 | 7538 | 6525 | KETOL-ACID REDUCTOISOMERASE (EC 1.1.1.86) |
| 263 | 264 | RXN03088 | VV0052 | 3431 | 3817 | Hypothetical Methyltransferase (EC 2.1.1.—) |
| 265 | 266 | RXN02952 | VV0320 | 1032 | 1547 | PUTATIVE REDUCTASE |
| 267 | 268 | RXN00513 | VV0092 | 1573 | 653 | CARBOXYVINYL-CARBOXYPHOSPHONATE PHOSPHORYL-MUTASE (EC 2.7.8.23) |
| 269 | 270 | RXN01152 | VV0136 | 1740 | 907 | PROTEIN-L-ISOASPARTATE O-METHYLTRANSFERASE (EC 2.1.1.77) |
| 271 | 272 | RXN00787 | VV0321 | 3736 | 5637 | D-AMINO ACID DEHYDROGENASE LARGE SUBUNIT (EC 1.4.99.1) |

N-metabolism

| | | | | | | |
|---|---|---|---|---|---|---|
| 273 | 274 | RXN01302 | VV0148 | 2837 | 2385 | NITRATE REDUCTASE ALPHA CHAIN (EC 1.7.99.4) |
| 275 | 276 | F RXA01302 | GR00376 | 370 | 5 | NITRATE REDUCTASE ALPHA CHAIN (EC 1.7.99.4) |
| 277 | 278 | RXN01308 | VV0148 | 2406 | 4 | NITRATE REDUCTASE ALPHA CHAIN (EC 1.7.99.4) |
| 279 | 280 | F RXA01307 | GR00377 | 686 | 6 | NITRATE REDUCTASE ALPHA CHAIN (EC 1.7.99.4) |
| 281 | 282 | F RXA01308 | GR00378 | 1211 | 6 | NITRATE REDUCTASE ALPHA CHAIN (EC 1.7.99.4) |
| 283 | 284 | RXN01309 | VV0158 | 1 | 801 | NITRATE REDUCTASE ALPHA CHAIN (EC 1.7.99.4) |
| 285 | 286 | F RXA01309 | GR00379 | 719 | 51 | NITRATE REDUCTASE ALPHA CHAIN (EC 1.7.99.4) |
| 287 | 288 | RXA02017 | GR00610 | 1731 | 1048 | NITRATE REDUCTASE ALPHA CHAIN (EC 1.7.99.4) |
| 289 | 290 | RXA02018 | GR00610 | 2788 | 1739 | NITRATE REDUCTASE BETA CHAIN (EC 1.7.99.4) |
| 291 | 292 | RXA02016 | GR00610 | 1036 | 260 | NITRATE REDUCTASE GAMMA CHAIN (EC 1.7.99.4) |
| 293 | 294 | RXA00471 | GR00119 | 2997 | 3686 | NITRATE/NITRITE RESPONSE REGULATOR PROTEIN NARL |
| 295 | 296 | RXA00133 | GR00021 | 201 | 1013 | NITRATE/NITRITE RESPONSE REGULATOR PROTEIN NARP |
| 297 | 298 | RXA00650 | GR00169 | 4017 | 3382 | NITRATE/NITRITE RESPONSE REGULATOR PROTEIN NARP |
| 299 | 300 | RXA01189 | GR00339 | 2545 | 1937 | NITRATE/NITRITE RESPONSE REGULATOR PROTEIN NARP |
| 301 | 302 | RXA01607 | GR00449 | 123 | 752 | NITRATE/NITRITE RESPONSE REGULATOR PROTEIN NARP |
| 303 | 304 | RXN00470 | VV0086 | 27401 | 28669 | NITRATE/NITRITE SENSOR PROTEIN NARX (EC 2.7.3.—) |
| 305 | 306 | F RXA00470 | GR00119 | 1752 | 2951 | NITRATE/NITRITE SENSOR PROTEIN NARX (EC 2.7.3.—) |
| 307 | 308 | RXA00756 | GR00203 | 2932 | 1937 | N UTILIZATION SUBSTANCE PROTEIN A |
| 309 | 310 | RXA00139 | GR00022 | 2514 | 3224 | N UTILIZATION SUBSTANCE PROTEIN B |
| 311 | 312 | RXA01303 | GR00376 | 1724 | 390 | NITRITE EXTRUSION PROTEIN |
| 313 | 314 | RXA01412 | GR00412 | 620 | 417 | NITROGEN FIXATION PROTEIN FIXI (PROBABLE E1-E2 TYPE CATION ATPASE) (EC 3.6.1.—) |
| 315 | 316 | RXA00773 | GR00205 | 3208 | 4350 | NITROGEN REGULATION PROTEIN NIFR3 |
| 317 | 318 | RXA02746 | GR00764 | 1 | 267 | NITROGEN REGULATORY PROTEIN P-II |
| 319 | 320 | RXA02745 | GR00763 | 15350 | 14472 | NODULATION ATP-BINDING PROTEIN I |
| 321 | 322 | RXN00820 | VV0054 | 19455 | 19817 | NODULATION PROTEIN N |
| 323 | 324 | F RXA00820 | GR00221 | 1007 | 1369 | NODULATION PROTEIN N |
| 325 | 326 | RXA01059 | GR00296 | 8782 | 9390 | OXYGEN-INSENSITIVE NAD(P)H NITROREDUCTASE (EC 1.—.—.—) |
| 327 | 328 | RXN01386 | VV0008 | 39246 | 38317 | NITRILASE REGULATOR |
| 329 | 330 | RXN00073 | VV0154 | 2369 | 687 | FERREDOXIN-NITRITE REDUCTASE (EC 1.7.7.1) |
| 331 | 332 | RXN03131 | VV0127 | 276 | 4 | RHIZOPINE CATABOLISM PROTEIN MOCC |
| 333 | 334 | RXS00153 | VV0167 | 4195 | 4620 | NODULATION PROTEIN |

Urease

Phosphate and Phosphonate metabolism

| | | | | | | |
|---|---|---|---|---|---|---|
| 335 | 336 | RXN01716 | VV0319 | 3259 | 2774 | EXOPOLYPHOSPHATASE (EC 3.6.1.11) |
| 337 | 338 | RXN02972 | VV0319 | 2763 | 2353 | EXOPOLYPHOSPHATASE (EC 3.6.1.11) |
| 339 | 340 | RXN00663 | VV0142 | 10120 | 11493 | PHOH PROTEIN HOMOLOG |
| 341 | 342 | RXN00778 | VV0103 | 18126 | 19250 | PHOSPHATE-BINDING PERIPLASMIC PROTEIN PRECURSOR |
| 343 | 344 | RXN00250 | VV0189 | 286 | 1032 | DEDA PROTEIN - ALKALINE PHOSPHATASE LIKE PROTEIN |

Sulfate metabolism

| | | | | | | |
|---|---|---|---|---|---|---|
| 345 | 346 | RXA00072 | GR00012 | 446 | 6 | PHOSPHOADENOSINE PHOSPHOSULFATE REDUCTASE (EC 1.8.99.4) |
| 347 | 348 | RXA00793 | GR00211 | 1469 | 2644 | SULFATE STARVATION-INDUCED PROTEIN 6 |
| 349 | 350 | RXA01192 | GR00342 | 161 | 733 | SULFATE STARVATION-INDUCED PROTEIN 6 |
| 351 | 352 | RXA00715 | GR00188 | 2120 | 2914 | THIOSULFATE SULFURTRANSFERASE (EC 2.8.1.1) |

TABLE 1-continued

Genes in the Application

| Nucleic Acid SEQ ID NO | Amino Acid SEQ ID NO | Identification Code | Contig. | NT Start | NT Stop | Function |
|---|---|---|---|---|---|---|
| 353 | 354 | RXA01664 | GR00463 | 1306 | 485 | THIOSULFATE SULFURTRANSFERASE (EC 2.8.1.1) |
| 355 | 356 | RXN02334 | VV0141 | 7939 | 7217 | THIOSULFATE SULFURTRANSFERASE (EC 2.8.1.1) |
| 357 | 358 | F RXA02334 | GR00672 | 2 | 355 | THIOSULFATE SULFURTRANSFERASE (EC 2.8.1.1) |
| | | | | | | Fe-Metabolism |
| 359 | 360 | RXN01499 | VV0008 | 7034 | 3213 | ENTEROBACTIN SYNTHETASE COMPONENT F |
| 361 | 362 | RXN01997 | VV0084 | 33308 | 33793 | FERRITIN |
| | | | | | | Mg Metabolism |
| 363 | 364 | RXA01848 | GR00524 | 1532 | 789 | MAGNESIUM-CHELATASE SUBUNIT CHLI |
| 365 | 366 | RXN01849 | VV0139 | 16415 | 17515 | MAGNESIUM-CHELATASE SUBUNIT CHLI |
| 367 | 368 | F RXA01849 | GR00524 | 2004 | 1555 | MAGNESIUM-CHELATASE SUBUNIT CHLI |
| 369 | 370 | F RXA01691 | GR00474 | 570 | 4 | MAGNESIUM-CHELATASE SUBUNIT CHLI |
| 371 | 372 | RXN00665 | VV0252 | 135 | 635 | MG2+/CITRATE COMPLEX SECONDARY TRANSPORTER |
| | | | | | | Modification and degradation of aromatic compounds |
| 373 | 374 | RXN03026 | VV0007 | 28635 | 28901 | 3-DEHYDROQUINATE DEHYDRATASE (EC 4.2.1.10) |
| 375 | 376 | RXN02908 | VV0025 | 8507 | 8247 | O-SUCCINYLBENZOIC ACID--COA LIGASE (EC 6.2.1.26) |
| 377 | 378 | RXN03000 | VV0235 | 570 | 4 | SALICYLATE HYDROXYLASE (EC 1.14.13.1) |
| 379 | 380 | RXN03036 | VV0014 | 671 | 6 | PROTOCATECHUATE 3,4-DIOXYGENASE BETA CHAIN (EC 1.13.11.3) |
| 381 | 382 | RXN02974 | VV0229 | 12631 | 12437 | 4-NITROPHENYLPHOSPHATASE (EC 3.1.3.41) |
| 383 | 384 | RXN00393 | VV0025 | 7241 | 6348 | 1,4-DIHYDROXY-2-NAPHTHOATE OCTAPRENYLTRANSFERASE (EC 2.5.—.—) |
| 385 | 386 | RXN00948 | VV0107 | 4266 | 5384 | 12-oxophytodienoate reductase (EC 1.3.1.42) |
| 387 | 388 | RXN01923 | VV0020 | 3384 | 4133 | 2-HYDROXY-6-OXO-6-PHENYLHEXA-2,4-DIENOATE HYDROLASE (EC 3.7.1.—) |
| 389 | 390 | RXN00398 | VV0025 | 14633 | 13884 | 2-PYRONE-6-DICARBOXYLATE LACTONASE (EC 3.1.1.57) |
| 391 | 392 | RXN02813 | VV0128 | 13120 | 14118 | 3-CARBOXY-CIS,CIS-MUCONATE CYCLOISOMERASE HOMOLOG (EC 5.5.1.2) |
| 393 | 394 | RXN00136 | VV0134 | 13373 | 14467 | 3-DEHYDROQUINATE SYNTHASE (EC 4.6.1.3) |
| 395 | 396 | RXN02508 | VV0007 | 26733 | 28586 | 3-DEHYDROSHIKIMATE DEHYDRATASE (EC 4.2.1.—) |
| 397 | 398 | RXN02839 | VV0362 | 3 | 449 | 4-HYDROXYBENZOATE OCTAPRENYLTRANSFERASE (EC 2.5.1.—) |
| 399 | 400 | RXN00639 | VV0128 | 7858 | 8712 | CATECHOL 1,2-DIOXYGENASE (EC 1.13.11.1) |
| 401 | 402 | RXN02530 | VV0057 | 5469 | 6125 | DIMETHYLANILINE MONOOXYGENASE (N-OXIDE FORMING) 1 (EC 1.14.13.8) |
| 403 | 404 | RXN00434 | VV0112 | 12078 | 11212 | QUINONE OXIDOREDUCTASE (EC 1.6.5.5) |
| 405 | 406 | RXN01619 | VV0050 | 24649 | 23675 | QUINONE OXIDOREDUCTASE (EC 1.6.5.5) |
| 407 | 408 | RXN01842 | VV0234 | 1615 | 2532 | QUINONE OXIDOREDUCTASE (EC 1.6.5.5) |
| 409 | 410 | RXN00641 | VV0128 | 7440 | 5950 | TOLUATE 1,2-DIOXYGENASE ALPHA SUBUNIT (EC 1.14.12.—) |
| 411 | 412 | RXN01993 | VV0182 | 16 | 1143 | VANILLATE DEMETHYLASE (EC 1.14.—.—) |
| 413 | 414 | RXN00658 | VV0083 | 15705 | 16397 | PHENOL 2-MONOOXYGENASE (EC 1.14.13.7) |
| 415 | 416 | RXN00178 | VV0174 | 14670 | 15554 | hydroxyquinol 1,2-dioxygenase (EC 1.13.11.37) |
| 417 | 418 | RXN01461 | VV0128 | 12414 | 13025 | PROTOCATECHUATE 3,4-DIOXYGENASE ALPHA CHAIN (EC 1.13.11.3) |
| 419 | 420 | RXN01653 | VV0321 | 12867 | 11407 | DIBENZOTHIOPHENE DESULFURIZATION ENZYME A |
| 421 | 422 | RXN02053 | VV0009 | 39448 | 40026 | DRGA PROTEIN |
| 423 | 424 | RXN00177 | VV0174 | 13589 | 14656 | MALEYLACETATE REDUCTASE (EC 1.3.1.32) |
| 425 | 426 | RXC00963 | VV0249 | 1816 | 2652 | PROTEIN involved in degradation of aromatic compounds |
| | | | | | | Modification and degradation of aliphatic compounds |
| 427 | 428 | RXN00299 | VV0176 | 43379 | 42402 | ALKANAL MONOOXYGENASE ALPHA CHAIN (EC 1.14.14.3) |
| 429 | 430 | F RXA00299 | GR00048 | 7376 | 6633 | ALKANAL MONOOXYGENASE ALPHA CHAIN (EC 1.14.14.3) |
| 431 | 432 | RXA00332 | GR00057 | 16086 | 15385 | ALKANAL MONOOXYGENASE ALPHA CHAIN (EC 1.14.14.3) |
| 433 | 434 | RXA01838 | GR00519 | 2 | 820 | ALKANAL MONOOXYGENASE ALPHA CHAIN (EC 1.14.14.3) |
| 435 | 436 | RXA02643 | GR00750 | 1603 | 560 | ALKANAL MONOOXYGENASE ALPHA CHAIN (EC 1.14.14.3) |
| 437 | 438 | RXA01933 | GR00555 | 6590 | 7192 | 2-HALOALKANOIC ACID DEHALOGENASE I (EC 3.8.1.2) |
| 439 | 440 | RXA02351 | GR00679 | 132 | 1070 | NITRILOTRIACETATE MONOOXYGENASE COMPONENT A (EC 1.14.13.—) |

TABLE 2

GENES IDENTIFIED FROM GENBANK

| GenBank™ Accession No. | Gene Name | Gene Function | Reference |
|---|---|---|---|
| A09073 | ppg | Phosphoenol pyruvate carboxylase | Bachmann, B. et al. "DNA fragment coding for phosphoenolpyruvat corboxylase, recombinant DNA carrying said fragment, strains carrying the recombinant DNA and method for producing L-aminino acids using said strains," Patent: EP 0358940-A 3 03/21/90 |
| A45579, A45581, A45583, A45585, A45587 | | Threonine dehydratase | Moeckel, B. et al. "Production of L-isoleucine by means of recombinant micro-organisms with deregulated threonine dehydratase," Patent: WO 9519442-A 5 07/20/95 |
| AB003132 | murC; ftsQ; ftsZ | | Kobayashi, M. et al. "Cloning, sequencing, and characterization of the ftsZ gene from coryneform bacteria," Biochem. Biophys. Res. Commun., 236(2): 383–388 (1997) |
| AB015023 | murC; ftsQ | | Wachi, M. et al. "A murC gene from Coryneform bacteria," Appl. Microbiol. Biotechnol., 51(2): 223–228 (1999) |
| AB018530 | dtsR | | Kimura, E. et al. "Molecular cloning of a novel gene, dtsR, which rescues the detergent sensitivity of a mutant derived from *Brevibacterium lactofermentum*," Biosci. Biotechnol. Biochem., 60(10): 1565–1570 (1996) |
| AB018531 | dtsR1; dtsR2 | | |
| AB020624 | murI | D-glutamate racemase | |
| AB023377 | tkt | transketolase | |
| AB024708 | gltB; gltD | Glutamine 2-oxoglutarate aminotransferase large and small subunits | |
| AB025424 | acn | aconitase | |
| AB027714 | rep | Replication protein | |
| AB027715 | rep; aad | Replication protein; aminoglycoside adenyltransferase | |
| AF005242 | argC | N-acetylglutamate-5-semialdehyde dehydrogenase | |
| AF005635 | glnA | Glutamine synthetase | |
| AF030405 | hisF | cyclase | |
| AF030520 | argG | Argininosuccinate synthetase | |
| AF031518 | argF | Ornithine carbamolytransferase | |
| AF036932 | aroD | 3-dehydroquinate dehydratase | |
| AF038548 | pyc | Pyruvate carboxylase | |
| AF038651 | dciAE; apt; rel | Dipeptide-binding protein; adenine phosphoribosyltransferase; GTP pyrophosphokinase | Wehmeier, L. et al. "The role of the *Corynebacterium glutamicum* rel gene in (p)ppGpp metabolism," Microbiology, 144: 1853–1862 (1998) |
| AF041436 | argR | Arginine repressor | |
| AF045998 | impA | Inositol monophosphate phosphatase | |
| AF048764 | argH | Argininosuccinate lyase | |
| AF049897 | argC; argJ; argB; argD; argF; argR; argG; argH | N-acetylglutamylphosphate reductase; ornithine acetyltransferase; N-acetylglutamate kinase; acetyl-ornithine transminase; ornithine carbamoyltransferase; arginine repressor; argininosuccinate synthase; argininosuccinate lyase | |
| AF050109 | inhA | Enoyl-acyl carrier protein reductase | |
| AF050166 | hisG | ATP phosphoribosyltransferase | |
| AF051846 | hisA | Phosphoribosylformimino-5-amino-1-phosphoribosyl-4-imidazole-carboxamide isomerase | |
| AF052652 | metA | Homoserine O-acetyltransferase | Park, S. et al. "Isolation and analysis of metA, a methionine biosynthetic gene encoding homoserine acetyltransferase in *Corynebacterium glutamicum*," Mol. Cells., 8(3): 286–294 (1998) |
| AF053071 | aroB | Dehydroquinate synthetase | |
| AF060558 | hisH | Glutamine amidotransferase | |
| AF086704 | hisE | Phosphoribosyl-ATP-pyrophohydrolase | |
| AF114233 | aroA | 5-enolpyruvylshikimate 3-phosphate synthase | |
| AF116184 | panD | L-aspartate-alpha-decarboxylase precursor | Dusch, N. et al. "Expression of the *Corynebacterium glutamicum* panD gene encoding L-aspartate-alpha-decarboxylase leads to pantothenate overproduction in *Escherichia coli*," Appl. Environ. Microbiol., 65(4) 1530–1539 (1999) |
| AF124518 | aroD; aroE | 3-dehydroquinase; shikimate dehydrogenase | |
| AF124600 | aroC; aroK; aroB; pepQ | Chorismate synthase; shikimate kinase; 3-dehydroquinate synthase; putative cytoplasmic peptidase | |
| AF145897 | inhA | | |
| AF145898 | inhA | | |

TABLE 2-continued

GENES IDENTIFIED FROM GENBANK

| GenBank™ Accession No. | Gene Name | Gene Function | Reference |
|---|---|---|---|
| AF101436 | ectP | Transport of ectoine, glycine betaine, proline | Peter, H. et al. "*Corynebacterium glutamicum* is equipped with four secondary carriers for compatible solutes: Identification, sequencing, and characterization of the proline/ectoine uptake system, ProP, and the ectoine/proline/glycine betaine carrier, EctP," J. Bacteriol., 180(22): 6005–6012 (1998) |
| AJ004934 | dapD | Tetrahydrodipicolinate succinylase (incomplete[1]) | Wehrmann, A. et al. "Different modes of diaminopimelate synthesis and their role in cell wall integrity: A study with *Corynebacterium glutamicum*," J. Bacteriol., 180(12): 3159–3165 (1998) |
| AJ007732 | ppc; secG; amt; ocd; soxA | Phosphoenolpyruvate-carboxylase; ?; high affinity ammonium uptake protein; putative ornithine-cyclo-decarboxylase; sarcosine oxidase | |
| AJ010319 | ftsY, glnB, glnD; srp; amtP | Involved in cell division; PII protein; uridylyltransferase (uridylyl-removing enzmye); signal recognition particle; low affinity ammonium uptake protein | Jakoby, M. et al. "Nitrogen regulation in *Corynebacterium glutamicum*; Isolation of genes involved in biochemical characterization of corresponding proteins," FEMS Microbiol., 173(2): 303–310 (1999) |
| AJ132968 | cat | Chloramphenicol acetyl transferase | |
| AJ224946 | mqo | L-malate: quinone oxidoreductase | Molenaar, D. et al. "Biochemical and genetic characterization of the membrane-associated malate dehydrogenase (acceptor) from *Corynebacterium glutamicum*," Eur. J. Biochem., 254(2): 395–403 (1998) |
| AJ238250 | ndh | NADH dehydrogenase | |
| AJ238703 | porA | Porin | Lichtinger, T. et al. "Biochemical and biophysical characterization of the cell wall porin of *Corynebacterium glutamicum*: The channel is formed by a low molecular mass polypeptide," Biochemistry, 37(43): 15024–15032 (1998) |
| D17429 | | Transposable element IS31831 | Vertes, A. A. et al. "Isolation and characterization of IS31831, a transposable element from *Corynebacterium glutamicum*," Mol. Microbiol., 11(4): 739–746 (1994) |
| D84102 | odhA | 2-oxoglutarate dehydrogenase | Usuda, Y. et al. "Molecular cloning of the *Corynebacterium glutamicum* (*Brevibacterium lactofermentum* AJ12036) odhA gene encoding a novel type of 2-oxoglutarate dehydrogenase," Microbiology, 142: 3347–3354 (1996) |
| E01358 | hdh; hk | Homoserine dehydrogenase; homo-serine kinase | Katsumata, R. et al. "Production of L-thereonine and L-isoleucine," Patent: JP 1987232392-A 1 10/12/87 |
| E01359 | | Upstream of the start codon of homoserine kinase gene | Katsumata, R. et al. "Production of L-thereonine and L-isoleucine," Patent: JP 1987232392-A 2 10/12/87 |
| E01375 | | Tryptophan operon | |
| E01376 | trpL; trpE | Leader peptide; anthranilate synthase | Matsui, K. et al. "Tryptophan operon, peptide and protein coded thereby, utilization of tryptophan operon gene expression and production of tryptophan," Patent: JP 1987244382-A 1 10/24/87 |
| E01377 | | Promoter and operator regions of tryptophan operon | Matsui, K. et al. "Tryptophan operon, peptide and protein coded thereby, utilization of tryptophan operon gene expression and production of tryptophan," Patent: JP 1987244382-A 1 10/24/87 |
| E03937 | | Biotin-synthase | Hatakeyama, K. et al. "DNA fragment containing gene capable of coding biotin synthetase and its utilization," Patent: JP 1992278088-A 1 10/02/92 |
| E04040 | | Diamino pelargonic acid amino-transferase | Kohama, K. et al. "Gene coding diaminopelargonic acid aminotransferase and desthiobiotin synthetase and its utilization," Patent: JP 1992330284-A 1 11/18/92 |
| E04041 | | Desthiobiotinsynthetase | Kohama, K. et al. "Gene coding diaminopelargonic acid aminotransferase and desthiobiotin synthetase and its utilization," Patent: JP 1992330284-A 1 11/18/92 |
| E04307 | | Flavum aspartase | Kurusu, Y. et al. "Gene DNA coding aspartase and utilization thereof," Patent: JP 1993030977-A 1 02/09/93 |
| E04376 | | Isocitric acid lyase | Katsumata, R. et al. "Gene manifestation controlling DNA," Patent: JP 1993056782-A 3 03/09/93 |
| E04377 | | Isocitric acid lyase N-terminal fragment | Katsumata, R. et al. "Gene manifestation controlling DNA," Patent: JP 1993056782-A 3 03/09/93 |
| E04484 | | Prephenate dehydratase | Sotouchi, N. et al. "Production of L-phenylalanine by fermentation," Patent: JP 1993076352-A 2 03/30/93 |
| E05108 | | Aspartokinase | Fugono, N. et al. "Gene DNA coding Aspartokinase and its use," Patent: JP 1993184366-A 1 07/27/93 |
| E05112 | | Dihydro-dipichorinate synthetase | Hatakeyama, K. et al. "Gene DNA coding dihydrodipicolinic acid synthetase and its use," Patent: JP 1993184371-A 1 07/27/93 |
| E05776 | | Diaminopimelic acid dehydrogenase | Kobayashi, M. et al. "Gene DNA coding Diaminopimelic acid dehydrogenase and its use," Patent: JP 1993284970-A 1 11/02/93 |
| E05779 | | Threonine synthase | Kohama, K. et al. "Gene DNA coding threonine synthase and its use," Patent: JP 1993284972-A 1 11/02/93 |
| E06110 | | Prephenate dehydratase | Kikuchi, T. et al. "Production of L-phenylalanine by fermentation method," Patent: JP 1993344881-A 1 12/27/93 |
| E06111 | | Mutated Prephenate dehydratase | Kikuchi, T. et al. "Production of L-phenylalanine by fermentation method," Patent: JP 1993344881-A 1 12/27/93 |
| E06146 | | Acetohydroxy acid synthetase | Inui, M. et al. "Gene capable of coding Acetohydroxy acid synthetase and its use," Patent: JP 1993344893-A 1 12/27/93 |
| E06825 | | Aspartokinase | Sugimoto, M. et al. "Mutant aspartokinase gene," patent: JP 1994062866-A 1 03/08/94 |

TABLE 2-continued

GENES IDENTIFIED FROM GENBANK

| GenBank™ Accession No. | Gene Name | Gene Function | Reference |
|---|---|---|---|
| E06826 | | Mutated aspartokinase alpha subunit | Sugimoto, M. et al. "Mutant aspartokinase gene," patent: JP 1994062866-A 1 03/08/94 |
| E06827 | | Mutated aspartokinase alpha subunit | Sugimoto, M. et al. "Mutant aspartokinase gene," patent: JP 1994062866-A 1 03/08/94 |
| E07701 | secY | | Honno, N. et al. "Gene DNA participating in integration of membraneous protein to membrane," Patent: JP 1994169780-A 1 06/21/94 |
| E08177 | | Aspartokinase | Sato, Y. et al. "Genetic DNA capable of coding Aspartokinase released from feedback inhibition and its utilization," Patent: JP 1994261766-A 1 09/20/94 |
| E08178, E08179, E08180, E08181, E08182, | | Feedback inhibition-released Aspartokinase | Sato, Y. et al. "Genetic DNA capable of coding Aspartokinase released from feedback inhibition and its utilization," Patent: JP 1994261766-A 1 09/20/94 |
| E08232 | | Acetohydroxy-acid isomeroreductase | Inui, M. et al. "Gene DNA coding acetohydroxy acid isomeroreductase," Patent: JP 1994277067-A 1 10/04/94 |
| E08234 | secE | | Asai, Y. et al. "Gene DNA coding for translocation machinery of protein," Patent: JP 1994277073-A 1 10/04/94 |
| E08643 | | FT aminotransferase and desthiobiotin synthetase promoter region | Hatakeyama, K. et al. "DNA fragment having promoter function in coryneform bacterium," Patent: JP 1995031476-A 1 02/03/95 |
| E08646 | | Biotin synthetase | Hatakeyama, K. et al. "DNA fragment having promoter function in coryneform bacterium," Patent: JP 1995031476-A 1 02/03/95 |
| E08649 | | Aspartase | Kohama, K. et al "DNA fragment having promoter function in coryneform bacterium," Patent: JP 1995031478-A 1 02/03/95 |
| E08900 | | Dihydrodipicolinate reductase | Madori, M. et al. "DNA fragment containing gene coding Dihydro-dipicolinate acid reductase and utilization thereof," Patent: JP 1995075578-A 1 03/20/95 |
| E08901 | | Diaminopimelic acid decarboxylase | Madori, M. et al. "DNA fragment containing gene coding Diaminopimelic acid decarboxylase and utilization thereof," Patent: JP 1995075579-A 1 03/20/95 |
| E12594 | | Serine hydroxymethyltransferase | Hatakeyama, K. et al. "Production of L-trypophan," Patent: JP 1997028391-A 1 02/04/97 |
| E12760, E12759, E12758 | | transposase | Moriya, M. et al. "Amplification of gene using artificial transposon," Patent: JP 1997070291-A 03/18/97 |
| E12764 | | Arginyl-tRNA synthetase; diaminopimelic acid decarboxylase | Moriya, M. et al. "Amplification of gene using artificial transposon," Patent: JP 1997070291-A 03/18/97 |
| E12767 | | Dihydrodipicolinic acid synthetase | Moriya, M. et al. "Amplification of gene using artificial transposon," Patent: JP 1997070291-A 03/18/97 |
| E12770 | | aspartokinase | Moriya, M. et al. "Amplification of gene using artificial transposon," Patent: JP 1997070291-A 03/18/97 |
| E12773 | | Dihydrodipicolinic acid reductase | Moriya, M. et al. "Amplification of gene using artificial transposon," Patent: JP 1997070291-A 03/18/97 |
| E13655 | | Glucose-6-phosphate dehydrogenase | Hatakeyama, K. et al. "Glucose-6-phosphate dehydrogenase and DNA capable of coding the same," Patent: JP 1997224661-A 1 09/02/97 |
| L01508 | IlvA | Threonine dehydratase | Moeckel, B. et al. "Functional and structural analysis of the threonine dehydratase of Corynebacterium glutamicum," J. Bacteriol., 174: 8065–8072 (1992) |
| L07603 | EC 4.2.1.15 | 3-deoxy-D-arabinoheptulosonate-7-phosphate synthase | Chen, C. et al. "The cloning and nucleotide sequence of Corynebacterium glutamicum 3-deoxy-D-arabinoheptulosonate-7-phosphate synthase gene," FEMS Microbiol. Lett., 107: 223–230 (1993) |
| L09232 | IlvB; ilvN; ilvC | Acetohydroxy acid synthase large subunit; Acetohydroxy acid synthase small subunit; Acetohydroxy acid isomeroreductase | Keilhauer, C. et al. "Isoleucine synthesis in Corynebacterium glutamicum: molecular analysis of the ilvB-ilvN-ilvC operon," J. Bacteriol., 175(17): 5595–5603 (1993) |
| L18874 | PtsM | Phosphoenolpyruvate sugar phosphotransferase | Fouet, A et al. "Bacillus subtilis sucrose-specific enzyme II of the phosphotransferase system: expression in Escherichia coli and homology to enzymes II from enteric bacteria," PNAS USA, 84(24): 8773–8777 (1987); Lee, J. K. et al. "Nucleotide sequence of the gene encoding the Corynebacterium glutamicum mannose enzyme II and analyses of the deduced protein sequence," FEMS Microbiol. Lett., 119(1–2): 137–145 (1994) |
| L27123 | aceB | Malate synthase | Lee, H-S. et al. "Molecular characterization of aceB, a gene encoding malate synthase in Corynebacterium glutamicum," J. Microbiol. Biotechnol., 4(4): 256–263 (1994) |
| L27126 | | Pyruvate kinase | Jetten, M. S. et al. "Structural and functional analysis of pyruvate kinase from Corynebacterium glutamicum," Appl. Environ. Microbiol., 60(7): 2501–2507 (1994) |
| L28760 | aceA | Isocitrate lyase | |
| L35906 | dtxr | Diphtheria toxin repressor | Oguiza, J. A. et al. "Molecular cloning, DNA sequence analysis, and characterization of the Corynebacterium diphtheriae dtxR from Brevibacterium lactofermentum," J. Bacteriol., 177(2): 465–467 (1995) |

TABLE 2-continued

GENES IDENTIFIED FROM GENBANK

| GenBank ™ Accession No. | Gene Name | Gene Function | Reference |
|---|---|---|---|
| M13774 | | Prephenate dehydratase | Follettie, M. T. et al. "Molecular cloning and nucleotide sequence of the *Corynebacterium glutamicum* pheA gene," J. Bacteriol., 167: 695–702 (1986) |
| M16175 | 5S rRNA | | Park, Y-H. et al. "Phylogenetic analysis of the coryneform bacteria by 56 rRNA sequences," J. Bacteriol., 169: 1801–1806 (1987) |
| M16663 | trpE | Anthranilate synthase, 5' end | Sano, K. et al. "Structure and function of the trp operon control regions of *Brevibacterium lactofermentum*, a glutamic-acid-producing bacterium," Gene, 52: 191–200 (1987) |
| M16664 | trpA | Tryptophan synthase, 3' end | Sano, K. et al. "Structure and function of the trp operon control regions of *Brevibacterium lactofermentum*, a glutamic-acid-producing bacterium," Gene, 52: 191–200 (1987) |
| M25819 | | Phosphoenolpyruvate carboxylase | O'Regan, M. et al. "Cloning and nucleotide sequence of the Phosphoenolpyruvate carboxylase-coding gene of *Corynebacterium glutamicum* ATCC13032," Gene, 77(2): 237–251 (1989) |
| M85106 | | 23S rRNA gene insertion sequence | Roller, C. et al. "Gram-positive bacteria with a high DNA G + C content are characterized by a common insertion within their 23S rRNA genes," J. Gen. Microbiol., 138: 1167–1175 (1992) |
| M85107, M85108 | | 23S rRNA gene insertion sequence | Roller, C. et al. "Gram-positive bacteria with a high DNA G + C content are characterized by a common insertion within their 23S rRNA genes," J. Gen. Microbiol., 138: 1167–1175 (1992) |
| M89931 | aecD; brnQ; yhbw | Beta C – S lyase; branched-chain amino acid uptake carrier; hypothetical protein yhbw | Rossol, I. et al. "The *Corynebacterium glutamicum* aecD gene encodes a C – S lyase with alpha, beta-elimination activity that degrades aminoethyl-cysteine," J. Bacteriol., 174(9): 2968–2977 (1992); Tauch, A. et al. "Isoleucine uptake in *Corynebacterium glutamicum* ATCC 13032 is directed by the brnQ gene product," Arch. Microbiol., 169(4): 303–312 (1998) |
| S59299 | trp | Leader gene (promoter) | Herry, D. M. et al. "Cloning of the trp gene cluster from a tryptophan-hyperproducing strain of *Corynebacterium glutamicum*: identification of a mutation in the trp leader sequence," Appl. Environ. Microbiol., 59(3): 791–799 (1993) |
| U11545 | trpD | Anthranilate phosphoribosyl-transferase | O'Gara, J. P. and Dunican, L. K. (1994) Complete nucleotide sequence of the *Corynebacterium glutamicum* ATCC 21850 tpD gene." Thesis, Microbiology Department, University College Galway, Ireland. |
| U13922 | cglIM; cglIR; clgIIR | Putative type II 5-cytosoine methyltransferase; putative type II restriction endonuclease; putative type I or type III restriction endonuclease | Schafer, A. et al. "Cloning and characterization of a DNA region encoding a stress-sensitive restriction system from *Corynebacterium glutamicum* ATCC 13032 and analysis of its role in intergeneric conjugation with *Escherichia coli*," J. Bacteriol., 176(23): 7309-7319 (1994); Schafer, A. et al. "The *Corynebacterium glutamicum* cglIM gene encoding a 5-cytosine in an McrBC-deficient *Escherichia coli* strain," Gene, 203(2): 95–101 (1997) |
| U14965 | recA | | |
| U31224 | ppx | | Ankri, S. et al. "Mutations in the *Corynebacterium glutamicum* proline biosynthetic pathway: A natural bypass of the proA step," J. Bacteriol., 178(15): 4412–4419 (1996) |
| U31225 | proC | L-proline: NADP+ 5-oxidoreductase | Ankri, S. et al. "Mutations in the *Corynebacterium glutamicum* proline biosynthetic pathway: A natural bypass of the proA step," J. Bacteriol., 178(15): 4412–4419 (1996) |
| U31230 | obg; proB; unkdh | ?; gamma glutamyl kinase; similar to D-isomer specific 2-hydroxyacid dehydrogenases | Ankri, S. et al. "Mutations in the *Corynebacterium glutamicum* proline biosynthetic pathway: A natural bypass of the proA step," J. Bacteriol., 178(15): 4412–4419 (1996) |
| U31281 | bioB | Biotin synthase | Serebriiskii, I. G., "Two new members of the bio B superfamily: Cloning, sequencing and expression of bio B genes of *Methylobacillus flagellatum* and *Corynebacterium glutamicum*," Gene, 175: 15–22 (1996) |
| U35023 | thtR; accBC | Thiosulfate sulfurtransferase; acyl CoA carboxylase | Jager, W. et al. "A *Corynebacterium glutamicum* gene encoding a two-domain protein similar to biotin carboxylases and biotin-carboxyl-carrier proteins," Arch. Microbiol., 166(2); 76–82 (1996) |
| U43535 | cmr | Multidrug resistance protein | Jager, W. et al. "A *Corynebacterium glutamicum* gene conferring multidrug resistance in the heterologous host *Escherichia coli*," J. Bacteriol., 179(7): 2449–2451 (1997) |
| U43536 | clpB | Heat shock ATP-binding protein | |
| U53587 | aphA-3 | 3'5"-aminoglycoside phospho-transferase | |
| U89648 | | *Corynebacterium glutamicum* unidentified sequence involved in histidine biosynthesis, partial sequence | |
| X04960 | trpA; trpB; trpC; trpD; trpE; trpG; trpL | Tryptophan operon | Matsui, K. et al. "Complete nucleotide and deduced amino acid sequences of the *Brevibacterium lactofermentum* tryptophan operon," Nucleic Acids Res., 14(24): 10113–10114 (1986) |
| X07563 | lys A | DAP decarboxylase (meso-diaminopimelate decarboxylase, EC 4.1.1.20) | Yeh, P. et al. "Nucleic sequence of the lysA gene of *Corynebacterium glutamicum* and possible mechanisms for modulation of its expression," Mol. Gen. Genet., 212(1): 112–119 (1988) |

TABLE 2-continued

GENES IDENTIFIED FROM GENBANK

| GenBank™ Accession No. | Gene Name | Gene Function | Reference |
|---|---|---|---|
| X14234 | EC 4.1.1.31 | Phosphoenolpyruvate carboxylase | Eikmanns, B. J. et al. "The Phosphoenolpyruvate carboxylase gene of *Corynebacterium glutamicum*: Molecular cloning, nucleotide sequence, and expression," Mol. Gen. Genet., 218(2): 330–339 (1989); Lepiniec, L. et al. "Sorghum Phosphoenolpyruvate carboxylase gene family: structure, function and molecular evolution," Plant. Mol. Biol., 21 (3): 487–502 (1993) |
| X17313 | fda | Fructose-bisphosphate aldolase | Von der Osten, C. H. et al. "Molecular cloning, nucleotide sequence and fine-structural analysis of the *Corynebacterium glutamicum* fda gene: structural comparison of *C. glutamicum* fructose-1, 6-biphosphate aldolase to class I and class II aldolases," Mol. Microbiol., |
| X53993 | dapA | L-2, 3-dihydrodipicolinate synthetase (EC 4.2.1.52) | Bonnassie, S. et al. "Nucleic sequence of the dapA gene from *Corynebacterium glutamicum*," Nucleic Acids Res., 18(21): 6421 (1990) |
| X54223 | | AttB-related site | Cianciotto, N. et al. "DNA sequence homology between att B-related sites of *Corynebacterium diphtheriae, Corynebacterium ulcerans, Corynebacterium glutamicum*, and the attP site of lambdacorynephage," FEMS. Microbiol, Lett., 66: 299–302 (1990) |
| X54740 | argS; lysA | Arginyl-tRNA synthetase; Diaminopimelate decarboxylase | Marcel, T. et al. "Nucleotide sequence and organization of the upstream region of the *Corynebacterium glutamicum* lysA gene," Mol. Microbiol., 4(11): 1819–1830 (1990) |
| X5 994 | trpL; trpE | Putative leader peptide; anthranilate synthase component 1 | Heery, D. M. et al. "Nucleotide sequence of the *Corynebacterium glutamicum* trpE gene," Nucleic Acids Res., 18(23): 7138 (1990) |
| X56037 | thrC | Threonine synthase | Han, K. S. et al. "The molecular structure of the *Corynebacterium glutamicum* threonine synthase gene," Mol. Microbiol., 4(10): 1693–1702 (1990) |
| X56075 | attB-related site | Attachment site | Cianciotto, N. et al. "DNA sequence homology between att B-related sites of *Corynebacterium diphtheriae, Corynebacterium ulcerans, Corynebacterium glutamicum*, and the attP site of lambdacorynephage," FEMS. Microbiol, Lett., 66: 299–302 (1990) |
| X57226 | lysC-alpha; lysC-beta; asd | Aspartokinase-alpha subunit; Aspartokinase-beta subunit; aspartate beta semialdehyde dehydrogenase | Kalinowski, J. et al. "Genetic and biochemical analysis of the Aspartokinase from *Corynebacterium glutamicum*," Mol. Microbiol., 5(5): 1197–1204 (1991); Kalinowski, J. et al. "Aspartokinase genes lysC alpha and lysC beta overlap and are adjacent to the aspertate beta-semialdehyde dehydrogenase gene asd in *Corynebacterium glutamicum*," Mol. Gen. Genet., 224(3): 317–324 (1990) |
| X59403 | gap; pgk; tpi | Glyceraldehyde-3-phosphate; phosphoglycerate kinase; triosephosphate isomerase | Eikmanns, B. J. "Identification, sequence analysis, and expression of a *Corynebacterium glutamicum* gene cluster encoding the three glycolytic enzymes glyceraldehyde-3-phosphate dehydrogenase, 3-phosphoglycerate kinase, and triosephosphate isomeras," J. Bacteriol., 174(19): 6076–6086 (1992) |
| X59404 | gdh | Glutamate dehydrogenase | Bormann, E. R. et al. "Molecular analysis of the *Corynebacterium glutamicum* gdh gene encoding glutamate dehydrogenase," Mol. Microbiol., 6(3): 317–326 (1992) |
| X60312 | lysI | L-lysine permease | Seep-Feldhaus, A. H. et al. "Molecular analysis of the *Corynebacterium glutamicum* lysI gene involved in lysine uptake," Mol. Microbiol., 5(12): 2995–3005 (1991) |
| X66078 | cop1 | Ps1 protein | Joliff, G. et al. "Cloning and nucleotide sequence of the csp1 gene encoding PS1, one of the two major secreted proteins of *Corynebacterium glutamicum*: The deduced N-terminal region of PS1 is similar to the Mycobacterium antigen 85 complex," Mol. Microbiol., 6(16): 2349–2362 (1992) |
| X66112 | glt | Citrate synthase | Eikmanns, B. J. et al. "Cloning sequence, expression and transcriptional analysis of the *Corynebacterium glutamicum* gltA gene encoding citrate synthase," Microbiol., 140: 1817–1828 (1994) |
| X 737 | dapB | Dihydrodipicolinate reductase | |
| X69103 | csp2 | Surface layer protein PS2 | Peyret, J. L. et al. "Characterization of the cspB gene encoding PS2, an ordered surface-layer protein in *Corynebacterium glutamicum*," Mol. Microbiol., 9(1): 97–109 (1993) |
| X69104 | | IS3 related insertion element | Bonamy, C. et al. "Identification of IS1206, a *Corynebacterium glutamicum* IS3-related insertion sequence and phylogenetic analysis," Mol. Microbiol., 14(3): 571–581 (1994) |
| X70959 | leuA | Isopropylmalate synthase | Patek, M. et al. "Leucine synthesis in *Corynebacterium glutamicum*: enzyme activities, structure of leuA, and effect of leuA inactivation on lysine synthesis," Appl. Environ. Microbiol., 60(1): 133–140 (1994) |
| X71489 | icd | Isocitrate dehydrogenase (NADP+) | Eikmanns, B. J. et al. "Cloning sequence analysis, expression, and inactivation of the *Corynebacterium glutamicum* icd gene encoding isocitrate dehydrogenase and biochemical characterization of the enzyme," J. Bacteriol., 177(3): 774–782 (1995) |
| X72855 | GDHA | Glutamate dehydrogenase (NADP+) | |
| X75083, X75084 | mtrA | 5-methyltryptophan resistance | Heery, D. M. et al. "A sequence from a tryptophan-hyperproducing strain of *Corynebacterium glutamicum* encoding resistance to 5-methyltryptophan," Biochem. Biophys. Res. Commun., 201(3): 1255–1262 (1994) |
| X75085 | recA | | Fitzpatrick, R. et al. "Construction and characterization of recA mutant strains of *Corynebacterium glutamicum* and *Brevibacterium lactofermentum*," Appl. Microbiol. Biotechnol., 42(4): 575–580 (1994) |

TABLE 2-continued

GENES IDENTIFIED FROM GENBANK

| GenBank ™ Accession No. | Gene Name | Gene Function | Reference |
|---|---|---|---|
| X75504 | aceA; thiX | Partial Isocitrate lyase; ? | Reinscheid, D. J. et al. "Characterization of the isocitrate lyase gene from *Corynebacterium glutamicum* and biochemical analysis of the enzyme," J. Bacteriol., 176(12): 3474–3483 (1994) |
| X76875 | | ATPase beta-subunit | Ludwig, W. et al. "Phylogenetic relationships of bacteria based on comparative sequence analysis of elongation factor Tu and ATP-synthase beta-subunit genes," Antonie Van Leeuwenhoek, 64: 285–305 (1993) |
| X77034 | tuf | Elongation factor Tu | Ludwig, W. et al. "Phylogenetic relationships of bacteria based on comparative sequence analysis of elongation factor Tu and ATP-synthase beta-subunit genes," Antonie Van Leeuwenhoek, 64: 285–305 (1993) |
| X77384 | recA | | Billman-Jacobe, H. "Nucleotide sequence of a recA gene from *Corynebacterium glutamicum*," DNA Seq., 4(6): 403–404 (1994) |
| X78491 | aceB | Malate synthase | Reinscheid, D. J. et al. "Malate synthase from *Corynebacterium glutamicum* pta-ack operon encoding phosphotransacetylase: sequence analysis," Microbiology, 140: 3099–3108 (1994) |
| X80629 | 16S rDNA | 16S ribosomal RNA | Rainey, F. A. et al. "Phylogenetic analysis of the genera Rhodococcus and Norcardia and evidence for the evolutionary origin of the genus Norcardia from within the radiation of Rhodococcus species," Microbiol., 141: 523–528 (1995) |
| X81191 | gluA; gluB; gluC; gluD | Glutamate uptake system | Kronemeyer, W. et al. "Structure of the gluABCD cluster encoding the glutamate uptake system of *Corynebacterium glutamicum*," J. Bacteriol., 177(5): 1152–1158 (1995) |
| X81379 | dapE | Succinyldiaminopimelate desuccinylase | Wehrmann, A. et al. "Analysis of different DNA fragments of *Corynebacterium glutamicum* complementing dapE of *Escherichia coli*," Microbiology, 40: 3349–56 (1994) |
| X82061 | 16S rDNA | 16S ribosomal RNA | Ruimy, R. et al. "Phylogeny of the genus Corynebacterium deduced from analyses of small-subunit ribosomal DNA sequences," Int. J. Syst. Bacteriol., 45(4): 740–746 (1995) |
| X82928 | asd; lysC | Aspartate-semialdehyde dehydrogenase; ? | Serebrijski, I. et al. "Multicopy suppression by asd gene and osmotic stress-dependent complementation by heterologous proA in proA mutants," J. Bacteriol., 177(24): 7255–7260 (1995) |
| X 929 | proA | Gamma-glutamyl phosphate reductase | Serebrijski, I. et al. "Multicopy suppression by asd gene and osmotic stress-dependent complementation by heterologous proA in proA mutants," J. Bacteriol., 177(24): 7255–7260 (1995) |
| X84257 | 16S rDNA | 16S ribosomal RNA | Pascual, C. et al. "Phylogenetic analysis of the genus Corynebacterium based on 16S rRNA gene sequences," Int. J. Syst. Bacteriol., 45(4): 724–728 (1995) |
| X85965 | aroP; dapE | Aromatic amino acid permease; ? | Wehrmann, A. et al. "Functional analysis of sequences adjacent to dapE of *Corynebacterium glutamicum* proline reveals the presence of aroP, which encodes the aromatic amino acid transporter," J. Bacteriol., 177(20): 5991–5993 (1995) |
| X86157 | argB; argC; argD; argF; argJ | Acetylglutamate kinase; N-acetyl-gamma-glutamyl-phosphate reductase; acetylornithine aminotransferase; ornithine carbamoyltransferase; glutamate N-acetyltransferase | Sakanyan, V. et al. "Genes and enzymes of the acetyl cycle of arginine biosynthesis in *Corynebacterium glutamicum*: enzyme evolution in the early steps of the arginine pathway," Microbiology, 142: 99–108 (1996) |
| X89084 | pta; ackA | Phosphate acetyltransferase; acetate kinase | Reinscheid, D. J. et al. "Cloning, sequence analysis, expression and inactivation of the *Corynebacterium glutamicum* pta-ack operon encoding phosphotransacetylase and acetate kinase," Microbiology, 145: 503–513 (1999) |
| X89850 | attB | Attachment site | Le Marrec, C. et al. "Genetic characterization of site-specific integration functions of phi AAU2 infecting "*Arthrobacter aureus* C70," J. Bacteriol., 178(7): 1996–2004 (1996) |
| X90356 | | Promoter fragment F1 | Patek, M. et al. "Promoters from *Corynebacterium glutamicum*: cloning, molecular analysis and search for a consensus motif," Microbiology, 142: 1297–1309 (1996) |
| X90357 | | Promoter fragment F2 | Patek, M. et al. "Promoters from *Corynebacterium glutamicum*: cloning, molecular analysis and search for a consensus motif," Microbiology, 142: 1297–1309 (1996) |
| X90358 | | Promoter fragment F10 | Patek, M. et al. "Promoters from *Corynebacterium glutamicum*: cloning, molecular analysis and search for a consensus motif," Microbiology, 142: 1297–1309 (1996) |
| X90359 | | Promoter fragment F13 | Patek, M. et al. "Promoters from *Corynebacterium glutamicum*: cloning, molecular analysis and search for a consensus motif," Microbiology, 142: 1297–1309 (1996) |
| X90360 | | Promoter fragment F22 | Patek, M. et al. "Promoters from *Corynebacterium glutamicum*: cloning, molecular analysis and search for a consensus motif," Microbiology, 142: 1297–1309 (1996) |
| X90361 | | Promoter fragment F34 | Patek, M. et al. "Promoters from *Corynebacterium glutamicum*: cloning, molecular analysis and search for a consensus motif," Microbiology, 142: 1297–1309 (1996) |
| X90362 | | Promoter fragment F37 | Patek, M. et al. "Promoters from *Corynebacterium glutamicum*: cloning, molecular analysis and search for a consensus motif," Microbiology, 142: 1297–1309 (1996) |

TABLE 2-continued

GENES IDENTIFIED FROM GENBANK

| GenBank ™ Accession No. | Gene Name | Gene Function | Reference |
|---|---|---|---|
| X90363 | | Promoter fragment F45 | Patek, M. et al. "Promoters from *Corynebacterium glutamicum*: cloning, molecular analysis and search for a consensus motif," Microbiology, 142: 1297–1309 (1996) |
| X90364 | | Promoter fragment F64 | Patek, M. et al. "Promoters from *Corynebacterium glutamicum*: cloning, molecular analysis and search for a consensus motif," Microbiology, 142: 1297–1309 (1996) |
| X90365 | | Promoter fragment F75 | Patek, M. et al. "Promoters from *Corynebacterium glutamicum*: cloning, molecular analysis and search for a consensus motif," Microbiology, 142: 1297–1309 (1996) |
| X90366 | | Promoter fragment PF101 | Patek, M. et al. "Promoters from *Corynebacterium glutamicum*: cloning, molecular analysis and search for a consensus motif," Microbiology, 142: 1297–1309 (1996) |
| X90367 | | Promoter fragment PF104 | Patek, M. et al. "Promoters from *Corynebacterium glutamicum*: cloning, molecular analysis and search for a consensus motif," Microbiology, 142: 1297–1309 (1996) |
| X90368 | | Promoter fragment PF109 | Patek, M. et al. "Promoters from *Corynebacterium glutamicum*: cloning, molecular analysis and search for a consensus motif," Microbiology, 142: 1297–1309 (1996) |
| X93513 | amt | Ammonium transport system | Siewe, R. M. et al. "Functional and genetic characterization of the (methyl) ammonium uptake carrier of *Corynebacterium glutamicum*," J. Biol. Chem., 271(10): 5398–5403 (1996) |
| X93514 | betP | Glycine betaine transport system | Peter, R. et al. "Isolation, characterization, and expression of the *Corynebacterium glutamicum* betP gene, encoding the transport system for the compatible solute glycine betaine," J. Bacteriol., 178(17): 5229–5234 (1996) |
| X9 649 | orf4 | | Patek, M. et al. "Identification and transcriptional analysis of the dapB-ORF2-dapA-ORF4 operon of *Corynebacterium glutamicum*, encoding two enzymes involved in L-lysine synthesis," Biotechnol. Lett., 19: 1113–1117 (1997) |
| X96471 | lysE; lysG | Lysine exporter protein; Lysine export regulator protein | Vrljic, M. et al. "A new type of transporter with a new type of cellular function: L-lysine export from *Corynebacterium glutamicum*," Mol. Microbiol., 22(5): 815–826 (1996) |
| X96580 | panB; panC; xylB | 3-methyl-2-oxobutanoate hydroxymethyltransferase; pantoate-beta-alanine ligase; xylulokinase | Sahm, H. et al. "D-pantothenate synthesis in *Corynebacterium glutamicum* and use of panBC and genes encoding L-valine synthesis for D-pantothenate overproduction," Appl. Environ. Microbiol., 65(5): 1973–1979 (1999) |
| X96962 | | Insertion sequence IS1207 and transposase | |
| X99289 | | Elongation factor P | Ramos, A. et al. "Cloning, sequencing and expression of the gene encoding elongation factor P in the amino-acid producer *Brevibacterium lactofermentum* (*Corynebacterium glutamicum* ATCC 13869)," Gene, 198: 217–222 (1997) |
| X 140 | thrB | Homoserine kinase | Mateos, L. M. et al. "Nucleotide sequence of the homoserine kinase (thrB) gene of the *Brevibacterium lactofermentum*," Nucleic Acids Res., 15(9): 3922 (1987) |
| Y00151 | ddh | Meso-diaminopimelate D-dehydrogenase (EC 1.4.1.16) | Ishino, S. et al. "Nucleotide sequence of the meso-diaminopimelate D-dehydrogenase gene from *Corynebacterium glutamicum*," Nucleic Acids Res., 15(9): 3917 (1987) |
| Y00476 | thrA | Homoserine dehydrogenase | Mateos, L. M. et al. "Nucleotide sequence of the homoserine dehydrogenase (thrA) gene of the *Brevibacterium lactofermentum*," Nucleic Acids Res., 15(24): 10598 (1987) |
| Y00546 | hom; thrB | Homoserine dehydrogenase; homoserine kinase | Peoples, O. P. et al. "Nucleotide sequence and fine structural analysis of the *Corynebacterium glutamicum* hom-thrB operon," Mol. Microbiol., 2(1): 63–72 (1988) |
| Y08964 | murC; ftsQ/divD; ftsZ | UPD-N-acetylmuramate-alanine ligase; division initiation protein or cell division protein; cell division protein | Honrubia, M. P. et al. "Identification, characterization, and chromosomal organization of the ftsZ gene from *Brevibacterium lactofermentum*," Mol. Gen. Genet., 259(1): 97–104 (1998) |
| Y09163 | putP | High affinity proline transport system | Peter, H. et al. "Isolation of the putP gene of *Corynebacterium glutamicum* proline and characterization of a low-affinity uptake system for compatible solutes," Arch. Microbiol., 168(2): 143–151 (1997) |
| Y 548 | pyc | Pyruvate carboxylase | Peters-Wendisch, P. G. et al. "Pyruvate carboxylase from *Corynebacterium glutamicum*: characterization, expression and inactivation of the pyc gene," Microbiology, 144: 915–927 (1998) |
| Y09578 | leuB | 3-isopropylmalate dehydrogenase | Patek, M. et al. "Analysis of the leuB gene from *Corynebacterium glutamicum*," Appl. Microbiol. Biotechnol., 50(1): 42–47 (1998) |
| Y12472 | | Attachment site bacteriophage Phi-16 | Moreau, S. et al. "Site-specific integration of corynephage Phi-16: The construction of an integration vector," Microbiol., 145: 539–548 (1999) |
| Y12537 | proP | Proline/ectoine uptake system protein | Peter, H. et al. "*Corynebacterium glutamicum* is equipped with four secondary carriers for compatible solutes: Identification, sequencing, and characterization of the proline/ectoine uptake system, ProP, and the ectoine/proline/glycine betaine carrier, EctP," J. Bacteriol., 180(22): 6005–6012 (1998) |

TABLE 2-continued

GENES IDENTIFIED FROM GENBANK

| GenBank ™ Accession No. | Gene Name | Gene Function | Reference |
|---|---|---|---|
| Y13221 | glnA | Glutamine synthetase I | Jakoby, M. et al. "Isolation of *Corynebacterium glutamicum* glnA gene encoding glutamine synthetase I," FEMS Microbiol. Lett., 154(1): 81–88 (1997) |
| Y 6642 | lpd | Dihydrolipoamide dehydrogenase | |
| Y 059 | | Attachment site Corynephage 304L | Moreau, S. et al. "Analysis of the integration functions of φ 304L: An integrase module among corynephages," Virology, 255(1): 150–159 (1999) |
| Z21501 | argS; lysA | Arginyl-tRNA synthetase; diaminopimelate decarboxylase (partial) | Oguiza, J. A. et al. "A gene encoding arginyl-tRNA synthetase is located in the upstream region of the lysA gene in *Brevibacterium lactofermentum*: Regulation of argS-lysA cluster expression by arginine," J. Bacteriol., 175(22): 7356–7362 (1993) |
| Z21502 | dapA; dapB | Dihydrodipicolinate synthase; dihydrodipicolinate reductase | Pisabarro, A. et al. "A cluster of three genes (dapA, orf2, and dapB) of *Brevibacterium lactofermentum* encodes dihydrodipicolinate reductase, and a third polypeptide of unknown function," J. Bacteriol., 175(9): 2743–2749 (1993) |
| Z29563 | thrC | Threonine synthase | Malumbres, M. et al. "Analysis and expression of the thrC gene of the encoded threonine synthase," Appl. Environ. Microbiol., 60(7)2209–2219 (1994) |
| Z46753 | 16S rDNA | Gene for 16S ribosomal RNA | |
| Z49822 | sigA | SigA sigma factor | Oguiza, J. A. et al "Multiple sigma factor genes in *Brevibacterium lactofermentum*: Characterization of sigA and sigB," J. Bacteriol., 178(2): 550–553 (1996) |
| Z49823 | galE; dtxR | Catalytic activity UDP-galactose 4-epimerase; diphtheria toxin regulatory protein | Oguiza, J. A. et al "The galE gene encoding the UDP-galactose 4-epimerase of *Brevibacterium lactofermentum* is coupled transcriptionally to the dmdR gene," Gene, 177: 103–107 (1996) |
| Z49824 | orf1; sigB | ?; SigB sigma factor | Oguiza, J. A. et al "Multiple sigma factor genes in *Brevibacterium lactofermentum*: Characterization of sigA and sigB," J. Bacteriol., 178(2): 550–553 (1996) |
| Z66534 | | Transposase | Correia, A. et al. "Cloning and characterization of an IS-like element present in the genome of *Brevibacterium lactofermentum* ATCC 13869," Gene, 170(1): 91–94 (1996) |

[1] A sequence for this gene was published in the indicated reference. However, the sequence obtained by the inventors of the present application is significantly longer than the published version. It is believed that the published version relied on an incorrect start codon, and thus represents only a fragment of the actual coding region.

TABLE 3

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Brevibacterium | ammoniagenes | 21054 | | | | | | | |
| Brevibacterium | ammoniagenes | 19350 | | | | | | | |
| Brevibacterium | ammoniagenes | 19351 | | | | | | | |
| Brevibacterium | ammoniagenes | 19352 | | | | | | | |
| Brevibacterium | ammoniagenes | 19353 | | | | | | | |
| Brevibacterium | ammoniagenes | 19354 | | | | | | | |
| Brevibacterium | ammoniagenes | 19355 | | | | | | | |
| Brevibacterium | ammoniagenes | 19356 | | | | | | | |
| Brevibacterium | ammoniagenes | 21055 | | | | | | | |
| Brevibacterium | ammoniagenes | 21077 | | | | | | | |
| Brevibacterium | ammoniagenes | 21553 | | | | | | | |
| Brevibacterium | ammoniagenes | 21580 | | | | | | | |
| Brevibacterium | ammoniagenes | 39101 | | | | | | | |
| Brevibacterium | butanicum | 21196 | | | | | | | |
| Brevibacterium | divaricatum | 21792 | P928 | | | | | | |
| Brevibacterium | flavum | 21474 | | | | | | | |
| Brevibacterium | flavum | 21129 | | | | | | | |
| Brevibacterium | flavum | 21518 | | | | | | | |
| Brevibacterium | flavum | | | B11474 | | | | | |
| Brevibacterium | flavum | | | B11472 | | | | | |
| Brevibacterium | flavum | 21127 | | | | | | | |
| Brevibacterium | flavum | 21128 | | | | | | | |
| Brevibacterium | flavum | 21427 | | | | | | | |
| Brevibacterium | flavum | 21475 | | | | | | | |
| Brevibacterium | flavum | 21517 | | | | | | | |
| Brevibacterium | flavum | 21528 | | | | | | | |
| Brevibacterium | flavum | 21529 | | | | | | | |
| Brevibacterium | flavum | | | B11477 | | | | | |
| Brevibacterium | flavum | | | B11478 | | | | | |
| Brevibacterium | flavum | 21127 | | | | | | | |
| Brevibacterium | flavum | | | B11474 | | | | | |

TABLE 3-continued

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Brevibacterium | healii | 15527 | | | | | | | |
| Brevibacterium | ketoglutamicum | 21004 | | | | | | | |
| Brevibacterium | ketoglutamicum | 21089 | | | | | | | |
| Brevibacterium | ketosoreductum | 21914 | | | | | | | |
| Brevibacterium | lactofermentum | | | | 70 | | | | |
| Brevibacterium | lactofermentum | | | | 74 | | | | |
| Brevibacterium | lactofermentum | | | | 77 | | | | |
| Brevibacterium | lactofermentum | 21798 | | | | | | | |
| Brevibacterium | lactofermentum | 21799 | | | | | | | |
| Brevibacterium | lactofermentum | 21800 | | | | | | | |
| Brevibacterium | lactofermentum | 21801 | | | | | | | |
| Brevibacterium | lactofermentum | | | B11470 | | | | | |
| Brevibacterium | lactofermentum | | | B11471 | | | | | |
| Brevibacterium | lactofermentum | 21086 | | | | | | | |
| Brevibacterium | lactofermentum | 21420 | | | | | | | |
| Brevibacterium | lactofermentum | 21086 | | | | | | | |
| Brevibacterium | lactofermentum | 31269 | | | | | | | |
| Brevibacterium | linens | 9174 | | | | | | | |
| Brevibacterium | linens | 19391 | | | | | | | |
| Brevibacterium | linens | 8377 | | | | | | | |
| Brevibacterium | paraffinolyticum | | | | | 11160 | | | |
| Brevibacterium | spec. | | | | | | 717.73 | | |
| Brevibacterium | spec. | | | | | | 717.73 | | |
| Brevibacterium | spec. | 14604 | | | | | | | |
| Brevibacterium | spec. | 21860 | | | | | | | |
| Brevibacterium | spec. | 21864 | | | | | | | |
| Brevibacterium | spec. | 21865 | | | | | | | |
| Brevibacterium | spec. | 21866 | | | | | | | |
| Brevibacterium | spec. | 19240 | | | | | | | |
| Corynebacterium | acetoacidophilum | 21476 | | | | | | | |
| Corynebacterium | acetoacidophilum | 13870 | | | | | | | |
| Corynebacterium | acetoglutamicum | | | B11473 | | | | | |
| Corynebacterium | acetoglutamicum | | | B11475 | | | | | |
| Corynebacterium | acetoglutamicum | 15806 | | | | | | | |
| Corynebacterium | acetoglutamicum | 21491 | | | | | | | |
| Corynebacterium | acetoglutamicum | 31270 | | | | | | | |
| Corynebacterium | acetophilum | | | B3671 | | | | | |
| Corynebacterium | ammoniagenes | 6872 | | | | | | 2399 | |
| Corynebacterium | ammoniagenes | 15511 | | | | | | | |
| Corynebacterium | fujiokense | 21496 | | | | | | | |
| Corynebacterium | glutamicum | 14067 | | | | | | | |
| Corynebacterium | glutamicum | 39137 | | | | | | | |
| Corynebacterium | glutamicum | 21254 | | | | | | | |
| Corynebacterium | glutamicum | 21255 | | | | | | | |
| Corynebacterium | glutamicum | 31830 | | | | | | | |
| Corynebacterium | glutamicum | 13032 | | | | | | | |
| Corynebacterium | glutamicum | 14305 | | | | | | | |
| Corynebacterium | glutamicum | 15455 | | | | | | | |
| Corynebacterium | glutamicum | 13058 | | | | | | | |
| Corynebacterium | glutamicum | 13059 | | | | | | | |
| Corynebacterium | glutamicum | 13060 | | | | | | | |
| Corynebacterium | glutamicum | 21492 | | | | | | | |
| Corynebacterium | glutamicum | 21513 | | | | | | | |
| Corynebacterium | glutamicum | 21526 | | | | | | | |
| Corynebacterium | glutamicum | 21543 | | | | | | | |
| Corynebacterium | glutamicum | 13287 | | | | | | | |
| Corynebacterium | glutamicum | 21851 | | | | | | | |
| Corynebacterium | glutamicum | 21253 | | | | | | | |
| Corynebacterium | glutamicum | 21514 | | | | | | | |
| Corynebacterium | glutamicum | 21516 | | | | | | | |
| Corynebacterium | glutamicum | 21299 | | | | | | | |
| Corynebacterium | glutamicum | 21300 | | | | | | | |
| Corynebacterium | glutamicum | 39684 | | | | | | | |
| Corynebacterium | glutamicum | 21488 | | | | | | | |
| Corynebacterium | glutamicum | 21649 | | | | | | | |
| Corynebacterium | glutamicum | 21650 | | | | | | | |
| Corynebacterium | glutamicum | 19223 | | | | | | | |
| Corynebacterium | glutamicum | 13869 | | | | | | | |
| Corynebacterium | glutamicum | 21157 | | | | | | | |
| Corynebacterium | glutamicum | 21158 | | | | | | | |
| Corynebacterium | glutamicum | 21159 | | | | | | | |
| Corynebacterium | glutamicum | 21355 | | | | | | | |

TABLE 3-continued

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Corynebacterium | glutamicum | 31808 | | | | | | | |
| Corynebacterium | glutamicum | 21674 | | | | | | | |
| Corynebacterium | glutamicum | 21562 | | | | | | | |
| Corynebacterium | glutamicum | 21563 | | | | | | | |
| Corynebacterium | glutamicum | 21564 | | | | | | | |
| Corynebacterium | glutamicum | 21565 | | | | | | | |
| Corynebacterium | glutamicum | 21566 | | | | | | | |
| Corynebacterium | glutamicum | 21567 | | | | | | | |
| Corynebacterium | glutamicum | 21568 | | | | | | | |
| Corynebacterium | glutamicum | 21569 | | | | | | | |
| Corynebacterium | glutamicum | 21570 | | | | | | | |
| Corynebacterium | glutamicum | 21571 | | | | | | | |
| Corynebacterium | glutamicum | 21572 | | | | | | | |
| Corynebacterium | glutamicum | 21573 | | | | | | | |
| Corynebacterium | glutamicum | 21579 | | | | | | | |
| Corynebacterium | glutamicum | 19049 | | | | | | | |
| Corynebacterium | glutamicum | 19050 | | | | | | | |
| Corynebacterium | glutamicum | 19051 | | | | | | | |
| Corynebacterium | glutamicum | 19052 | | | | | | | |
| Corynebacterium | glutamicum | 19053 | | | | | | | |
| Corynebacterium | glutamicum | 19054 | | | | | | | |
| Corynebacterium | glutamicum | 19055 | | | | | | | |
| Corynebacterium | glutamicum | 19056 | | | | | | | |
| Corynebacterium | glutamicum | 19057 | | | | | | | |
| Corynebacterium | glutamicum | 19058 | | | | | | | |
| Corynebacterium | glutamicum | 19059 | | | | | | | |
| Corynebacterium | glutamicum | 19060 | | | | | | | |
| Corynebacterium | glutamicum | 19185 | | | | | | | |
| Corynebacterium | glutamicum | 13286 | | | | | | | |
| Corynebacterium | glutamicum | 21515 | | | | | | | |
| Corynebacterium | glutamicum | 21527 | | | | | | | |
| Corynebacterium | glutamicum | 21544 | | | | | | | |
| Corynebacterium | glutamicum | 21492 | | | | | | | |
| Corynebacterium | glutamicum | | | B8183 | | | | | |
| Corynebacterium | glutamicum | | | B8182 | | | | | |
| Corynebacterium | glutamicum | | | B12416 | | | | | |
| Corynebacterium | glutamicum | | | B12417 | | | | | |
| Corynebacterium | glutamicum | | | B12418 | | | | | |
| Corynebacterium | glutamicum | | | B11476 | | | | | |
| Corynebacterium | glutamicum | 21608 | | | | | | | |
| Corynebacterium | lilium | | P973 | | | | | | |
| Corynebacterium | nitrilophilus | 21419 | | | | 11594 | | | |
| Corynebacterium | spec. | | P4445 | | | | | | |
| Corynebacterium | spec. | | P4446 | | | | | | |
| Corynebacterium | spec. | 31088 | | | | | | | |
| Corynebacterium | spec. | 31089 | | | | | | | |
| Corynebacterium | spec. | 31090 | | | | | | | |
| Corynebacterium | spec. | 31090 | | | | | | | |
| Corynebacterium | spec. | 31090 | | | | | | | |
| Corynebacterium | spec. | 15954 | | | | | | | 20145 |
| Corynebacterium | spec. | 21857 | | | | | | | |
| Corynebacterium | spec. | 21862 | | | | | | | |
| Corynebacterium | spec. | 21863 | | | | | | | |

ATCC: American Type Culture Collection, Rockville, MD, USA
FERM: Fermentation Research Institute, Chiba, Japan
NRRL: ARS Culture Collection, Northern Regional Research Laboratory, Peoria, IL, USA
CECT: Coleccion Espanola de Cultivos Tipo, Valencia, Spain
NCIMB: National Collection of Industrial and Marine Bacteria Ltd., Aberdeen, UK
CBS: Centraalbureau voor Schimmelcultures, Baarn, NL
NCTC: National Collection of Type Cultures, London, UK
DSMZ: Deutsche Sammlung von Mikroogranismen and Zellkulturen, Braunschweig, Germany For reference see Sugawara, H. et al. (1993) World directory of collections of cultures of microorganisms: Bacteria, fungi and yeasts (4th edn), World federation for culture collections world data center on microorganisms, Saimata, Japen.

TABLE 4

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00026 | 1509 | GB_RO:MMHC310M6 | 158405 | AF109906 | Mus musculus MHC class III region RD gene, partial cds; Bf, C2, G9A, NG22, G9, HSP70, HSP70, HSC70t, and smRNP genes, complete cds; G7A gene, partial cds; and unknown genes. | Mus musculus | 38,003 | 10-DEC.-1998 |
| | | GB_HTG2:AC007029 | 119007 | AC007029 | Homo sapiens clone DJ0855F16, *** SEQUENCING IN PROGRESS ***, 1 unordered pieces. | Homo sapiens | 37,943 | 7-Apr.-99 |
| | | GB_HTG2:AC007029 | 119007 | AC007029 | Homo sapiens clone DJ0855F16, *** SEQUENCING IN PROGRESS ***, 1 unordered pieces. | Homo sapiens | 37,943 | 7-Apr.-99 |
| rxa00072 | | | | | | | | |
| rxa00111 | 1116 | GB_BA1:SAUSIGA | 2748 | M94370 | Stigmatella aurantiaca sigma factor (sigA) gene, complete cds. | Stigmatella aurantiaca | 40,435 | 16-Aug.-94 |
| | | GB_BA1:SC5B8 | 28500 | AL022374 | Streptomyces coelicolor cosmid 5B8. | Streptomyces coelicolor | 40,090 | 22-Apr.-98 |
| | | GB_BA2:AE001767 | 9086 | AE001767 | Thermotoga maritima section 79 of 136 of the complete genome. | Thermotoga maritima | 35,091 | 2-Jun.-99 |
| rxa00112 | 1314 | GB_EST35:AU075536 | 418 | AU075536 | Rice shoot Oryza sativa cDNA clone S0028__2Z, mRNA sequence. | Oryza sativa | 39,423 | 7-Jul.-99 |
| | | GB_GSS9:AQ157585 | 647 | AQ157585 | nbxb0009B16r CUGI Rice BAC Library Oryza sativa genomic clone nbxb0009B16r, genomic survey sequence. | Oryza sativa | 40,867 | 12-Sep.-98 |
| | | GB_GSS14:AQ510314 | 542 | AQ510314 | nbxb0095O05f CUGI Rice BAC Library Oryza sativa genomic clone nbxb0095O05f, genomic survey sequence. | Oryza sativa | 39,372 | 04-MAY-1999 |
| rxa00133 | 936 | GB_BA1:SC2G5 | 38404 | AL035478 | Streptomyces coelicolor cosmid 2G5. | Streptomyces coelicolor | 41,170 | 11-Jun.-99 |
| | | GB_EST7:W64291 | 515 | W64291 | md98h12.r1 Soares mouse embryo NbME13.5 14.5 Mus musculus cDNA clone IMAGE:386087 5' similar to gb:L26528 Mus musculus Rab11b mRNA, complete cds (MOUSE), mRNA sequence. | Mus musculus | 35,306 | 10-Jun.-96 |
| rxa00137 | 1212 | GB_PR3:AC005624 | 39594 | AC005624 | Homo sapiens chromosome 19, cosmid R30017, complete sequence. | Homo sapiens | 39,054 | 6-Sep.-98 |
| | | GB_BA2:AF124600 | 4115 | AF124600 | Corynebacterium glutamicum chorismate synthase (aroC), shikimate kinase (aroK), and 3-dehydroquinate synthase (aroB) genes, complete cds; and putative cytoplasmic peptidase (pepQ) gene, partial cds. | Corynebacterium glutamicum | 99,867 | 04-MAY-1999 |
| | | GB_BA1:MTCY159 | 33818 | Z83863 | Mycobacterium tuberculosis H37Rv complete genome; segment 111/162. | Mycobacterium tuberculosis | 40,959 | 17-Jun.-98 |
| | | GB_BA1:MT3DEHQ | 3437 | X59509 | M.tuberculosis, genes for 3-dehydroquinate synthase and 3-dehydroquinase. | Mycobacterium tuberculosis | 52,583 | 30-Jun.-93 |
| rxa00139 | 834 | GB_BA1:BLELONP | 738 | X99289 | B.lactofermentum gene encoding elongation factor P. | Corynebacterium glutamicum | 100,000 | 1-Nov.-97 |
| | | GB_PL1:SPAC24C9 | 38666 | Z98601 | S.pombe chromosome I cosmid c24C9. | Schizosaccharomyces pombe | 35,230 | 24-Feb.-99 |
| rxa00152 | 1419 | GB_HTG1:CEY102A5_1 | 110000 | Z99711 | Caenorhabditis elegans chromosome V clone Y102A5, *** SEQUENCING IN PROGRESS ***, in unordered pieces. | Caenorhabditis elegans | 37,775 | Z99711 |
| | | GB_BA1:MTCY277 | 38300 | Z79701 | Mycobacterium tuberculosis H37Rv complete genome; segment 65/162. | Mycobacterium tuberculosis | 58,500 | 17-Jun.-98 |
| | | GB_BA1:MSGY456 | 37316 | AD000001 | Mycobacterium tuberculosis sequence from clone y456. | Mycobacterium tuberculosis | 38,913 | 03-DEC.-1996 |
| | | GB_BA1:AF002133 | 15437 | AF002133 | Mycobacterium avium strain GIR10 transcriptional regulator (mav81) gene, partial cds, aconitase (acn), invasin 1 (inv1), invasin 2 (inv2), transcriptional regulator (moxR), ketoacyl-reductase (fabG), enoyl-reductase (inhA) and ferrochelatase (mav272) genes, complete cds. | Mycobacterium avium | 64,009 | 26-MAR-1998 |
| rxa00226 | 948 | GB_PR3:AC005756 | 43299 | AC005756 | Homo sapiens chromosome 19, fosmid 39347, complete sequence. | Homo sapiens | 36,209 | 02-OCT-1998 |
| | | GB_GSS5:AQ818463 | 413 | AQ818463 | HS_5250_A2_B08_SP6E RPCI-11 Human Male BAC Library Homo sapiens genomic clone Plate=826 Col=16 Row=C, genomic survey | Homo sapiens | 37,288 | 26-Aug.-99 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_GSS5:AQ782337 | 832 | AQ782337 | HS_3184_B1_H12_T7C CIT Approved Human Genomic Sperm Library D Homo sapiens genomic clone Plate=3184 Col=23 Row=P, genomic survey sequence. | Homo sapiens | 35,917 | 2-Aug.-99 |
| rxa00249 | 980 | GB_BA2:AF035608 | 3614 | AF035608 | Pseudomonas aeruginosa ATP sulfurylase small subunit (cysD) and ATP sulfurylase GTP-binding subunit/APS kinase (cysN) genes, complete cds. | Pseudomonas aeruginosa | 50,205 | 1-Jun.-98 |
| | | GB_BA1:AB017641 | 17101 | AB017641 | Micromonospora griseorubida gene for polyketide synthase, complete cds. | Micromonospora griseorubida | 40,266 | 2-Apr.-99 |
| | | GB_BA2:AF002133 | 15437 | AF002133 | Mycobacterium avium strain GIR10 transcriptional regulator (mav81) gene, partial cds, aconitase (acn), invasin 1 (inv1), invasin 2 (inv2), transcriptional regulator (mav272) genes, complete cds. reductase (inhA) and ferrochelatase (mav272) genes, complete cds. | Mycobacterium avium | 38,429 | 26-MAR.-1998 |
| rxa00299 | 1101 | GB_BA2:CORCSLYS | 2821 | M89931 | Corynebacterium glutamicum beta C-S lyase (aecD) and branched-chain amino acid uptake carrier (brnQ) genes, complete cds, and hypothetical protein Yhbw (yhbw) gene, partial cds. | Corynebacterium glutamicum | 100,000 | 4-Jun.-98 |
| | | GB_BA1:CGECTP | 2719 | AJ001436 | Corynebacterium glutamicum ectP gene. | Corynebacterium glutamicum | 41,143 | 20-Nov.-98 |
| | | GB_BA2:AF181035 | 5922 | AF181035 | Rhodobacter sphaeroides glycogen utilization operon, complete sequence. | Rhodobacter sphaeroides | 36,701 | 7-Sep.-99 |
| rxa00332 | 825 | GB_BA1:CGTHRC | 3120 | X56037 | Corynebacterium glutamicum thrC gene for threonine synthase (EC 4.2.99.2). | Corynebacterium glutamicum | 37,730 | 17-Jun.-97 |
| | | GB_PAT:I09078 | 3146 | I09078 | Sequence 4 from Patent WO 8809819. | Unknown. | 38,700 | 02-DEC.-1994 |
| | | GB_PR3:HSJ333B15 | 73666 | AL109954 | Human DNA sequence from clone 333B15 on chromosome 20, complete sequence. | Homo sapiens | 37,203 | 23-Nov.-99 |
| rxa00470 | 1392 | GB_PL2:DCPCNAM | 865 | X62977 | D.carota mRNA for proliferating cell nuclear antigen (PCNA). | Daucus carota | 37,914 | 30-Sep.-99 |
| | | GB_PL2:AC006267 | 101644 | AC006267 | Arabidopsis thaliana BAC F9M13 from chromosome IV near 21.5 cM, complete sequence. | Arabidopsis thaliana | 36,158 | 27-Apr.-99 |
| rxa00471 | 813 | GB_BA1:TT10SARNA | 721 | Y15063 | Thermus thermophilus 10Sa RNA gene. | Thermus thermophilus | 39,494 | 18-Aug.-98 |
| | | GB_BA1:SERERYAA | 11219 | M63676 | S.erythraea first ORF of eryA gene, complete cds. | Saccharopolyspora erythraea | 38,781 | 26-Apr.-93 |
| | | GB_PAT:AR049367 | 11219 | AR049367 | Sequence 1 from U.S. Pat. No. 5824513. | Unknown. | 38,781 | 29-Sep.-99 |
| | | GB_BA1:SERERYAA | 11219 | M63676 | S.erythraea first ORF of eryA gene, complete cds. | Saccharopolyspora erythraea | 38,205 | 26-Apr.-93 |
| rxa00499 | 1404 | GB_PR4:AC007206 | 42732 | AC007206 | Homo sapiens chromosome 19, cosmid R27370, complete sequence. | Homo sapiens | 34,982 | 4-Apr.-99 |
| | | GB_EST26:AI344735 | 462 | AI344735 | qp05a10.x1 NCI_CGAP_Kid5 Homo sapiens cDNA clone IMAGE:1917114 3' similar to gb:M15800 T-LYMPHOCYTE MATURATION-ASSOCIATED PROTEIN (HUMAN); mRNA sequence. | Homo sapiens | 42,675 | 2-Feb.-99 |
| rxa00500 | 798 | GB_PR4:AC006479 | 161837 | AC006479 | Homo sapiens clone DJ1051J04, complete sequence. | Homo sapiens | 38,462 | 11-Nov.-99 |
| | | GB_PR4:AC006111 | 190825 | AC006111 | Homo sapiens chromosome 16 clone RPCI-11_461A8, complete sequence. | Homo sapiens | 40,736 | 3-Jul.-99 |
| | | GB_HTG2:AF128834 | 196589 | AF128834 | Homo sapiens chromosome 8 clone BAC 57G24 map 8p12, *** SEQUENCING IN PROGRESS ***, in unordered pieces. | Homo sapiens | 34,062 | 28-Feb.-99 |
| | | GB_HTG2:AF128834 | 196589 | AF128834 | Homo sapiens chromosome 8 clone BAC 57G24 map 8p12, *** SEQUENCING IN PROGRESS ***, in unordered pieces. | Homo sapiens | 34,062 | 28-Feb.-99 |

TABLE 4-continued
ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00501 | 630 | GB_BA1:D86429 | 5925 | D86429 | *Saccharopolyspora rectivirgula* gene for beta-galactosidase, complete cds. | *Saccharopolyspora rectivirgula* | 53,871 | 09-DEC.-1998 |
| | | GB_HTG1:HS1099D15 | 1301 | AL035456 | *Homo sapiens* chromosome 20 clone RP5-1099D15, *** SEQUENCING IN PROGRESS ***, in unordered pieces. | *Homo sapiens* | 33,546 | 23-Nov.-99 |
| | | GB_HTG1:HS1099D15 | 1301 | AL035456 | *Homo sapiens* chromosome 20 clone RP5-1099D15, *** SEQUENCING IN PROGRESS ***, in unordered pieces. | *Homo sapiens* | 33,546 | 23-Nov.-99 |
| rxa00502 | 1155 | GB_BA2:U00015 | 42325 | U00015 | *Mycobacterium leprae* cosmid B1620. | *Mycobacterium leprae* | 34,783 | 01-MAR-1994 |
| | | GB_BA1:U00020 | 36947 | U00020 | *Mycobacterium leprae* cosmid B229. | *Mycobacterium leprae* | 34,900 | 01-MAR-1994 |
| | | GB_HTG1:HS179I15 | 210672 | Z84464 | *Homo sapiens* chromosome 13 clone 179I15, *** SEQUENCING IN PROGRESS ***, in unordered pieces. | *Homo sapiens* | 32,898 | 22-Jan.-97 |
| rxa00566 | 729 | GB_BA1:MTV008 | 63033 | AL021246 | *Mycobacterium tuberculosis* H37Rv complete genome; segment 108/162. | *Mycobacterium tuberculosis* | 37,011 | 17-Jun.-98 |
| | | GB_BA1:AF071885 | 2188 | AF071885 | *Streptomyces coelicolor* ATP-dependent Clp protease proteolytic subunit 1 (clpP1) and ATP-dependent Clp protease proteolytic subunit 2 (clpP2) genes, complete cds; and ATP-dependent Clp protease ATP-binding subunit Clpx (clpX) gene, partial cds. | *Streptomyces coelicolor* | 62,963 | 29-Jun.-99 |
| | | GB_BA1:AF013216 | 15742 | AF013216 | *Myxococcus xanthus* Dog (dog), isocitrate lyase (icl), Mls (mls), Ufo (ufo), fumarate hydratase (fhy), and proteosome major subunit (clpP) genes, complete cds; and acyl-CoA oxidase (aco) gene, partial cds. | *Myxococcus xanthus* | 54,683 | 28-Jan.-98 |
| rxa00567 | 714 | GB_BA1:MTV008 | 63033 | AL021246 | *Mycobacterium tuberculosis* H37Rv complete genome; segment 108/162. | *Mycobacterium tuberculosis* | 42,090 | 17-Jun.-98 |
| | | GB_BA1:CGBPHI16 | 962 | Y12472 | *C.glutamicum* DNA, attachment site bacteriophage Phi-16. | *Corynebacterium glutamicum* | 40,000 | 05-MAR.-1999 |
| | | GB_BA1:ECOCLPPA | 1236 | J05534 | *Escherichia coli* ATP-dependent clp protease proteolytic component (clpP) gene, complete cds. | *Escherichia coli* | 52,119 | 26-Apr.-93 |
| rxa00621 | 906 | GB_EST1:D36491 | 360 | D36491 | CELK033GYF Yuji Kohara unpublished cDNA *Caenorhabditis elegans* cDNA clone yk33g11 5', mRNA sequence. | *Caenorhabditis elegans* | 40,390 | 8-Aug.-94 |
| | | GB_IN2:CELC16A3 | 34968 | U41534 | *Caenorhabditis elegans* cosmid C16A3. | *Caenorhabditis elegans* | 35,477 | 18-MAY-1999 |
| | | GB_HTG3:AC009311 | 160198 | AC009311 | *Homo sapiens* clone NH0311L03, ***SEQUENCING IN PROGRESS ***, 3 unordered pieces. | *Homo sapiens* | 38,636 | 13-Aug.-99 |
| rxa00622 | 1539 | GB_BA1:AB004795 | 3039 | AB004795 | *Pseudomonas* sp. gene for dipeptidyl aminopeptidase, complete cds. | *Pseudomonas* sp. | 54,721 | 5-Feb.-99 |
| | | GB_BA1:MBOPII | 2392 | D38405 | *Moraxella lacunata* gene for protease II, complete cds. | *Moraxella lacunata* | 50,167 | 8-Feb.-99 |
| | | GB_IN2:AF078916 | 2960 | AF078916 | *Trypanosoma brucei brucei* oligopeptidase B (opb) gene, complete cds. | *Trypanosoma brucei brucei* | 48,076 | 08-OCT-1999 |
| rxa00650 | 759 | GB_BA2:AF161327 | 2021 | AF161327 | *Corynebacterium diphtheriae* histidine kinase ChrS (chrS) and response regulator ChrA (chrA) genes, complete cds. | *Corynebacterium diphtheriae* | 51,319 | 9-Sep.-99 |
| | | GB_PL2:ATAC006533 | 99188 | AC006533 | *Arabidopsis thaliana* chromosome II BAC F20M17 genomic sequence, complete sequence. | *Arabidopsis thaliana* | 38,051 | 26-MAY-1999 |
| | | GB_PL2:ATAC006533 | 99188 | AC006533 | *Arabidopsis thaliana* chromosome II BAC F20M17 genomic sequence, complete sequence. | *Arabidopsis thaliana* | 35,403 | 26-MAY-1999 |
| rxa00675 | 915 | GB_BA1:SC3C8 | 33095 | AL023861 | *Streptomyces coelicolor* cosmid 3C8. | *Streptomyces coelicolor* | 36,836 | 15-Jan.-99 |
| | | GB_PR3:AC005736 | 215441 | AC005736 | *Homo sapiens* chromosome 16, BAC clone 462G18 (LANL), complete sequence. | *Homo sapiens* | 42,027 | 01-OCT-1998 |
| rxa00689 | 1614 | GB_IN2:AC005719 | 188357 | AC005719 | *Drosophila melanogaster*, chromosome 2L, region 38A5-38B4, BAC clone BACR48M05, complete sequence. | *Drosophila melanogaster* | 35,531 | 27-OCT-1999 |
| | | GB_PAT:E07294 | 2975 | E07294 | genomic DNA encoding dehydrogenase of *Bacillus stearothermophilus*. | *Bacillus stearothermophilus* | 45,677 | 29-Sep.-97 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_BA1:BACALDHT | 1975 | D13846 | *B. stearothermophilus* aldhT gene for aldehyde dhydrogenase, complete cds. | *Bacillus stearothermophilus* | 45,677 | 20-Feb.-99 |
| | | GB_BA2:PPU96338 | 5276 | U96338 | *Pseudomonas putida* NCIMB 9866 plasmid pRA4000 p-cresol degradative pathway genes, p-hydroxybenzaldehyde dehydrogenase (pchA), p-cresol methylhydroxylase, cytochrome subunit precursor (pchC), unknown (pchX) and p-cresol methylhydroxylase, flavoprotein subunit (pchF) genes, complete cds. | *Pseudomonas putida* | 44,317 | 13-MAY-1999 |
| rxa00715 | 918 | GB_EST30:AI647104 | 218 | AI647104 | vn15c01.y1 Stratagene mouse heart (#937316) *Mus musculus* cDNA clone IMAGE:1021248 5', mRNA sequence. | *Mus musculus* | 58,511 | 29-Apr-99 |
| | | GB_EST17:AA636159 | 447 | AA636159 | vn15c01.r1 Stratagene mouse heart (#937316) *Mus musculus* cDNA clone IMAGE:1021248 5', mRNA sequence. | *Mus musculus* | 41,195 | 22-OCT.-1997 |
| | | GB_EST10:AA184468 | 583 | AA184468 | mt52h05.r1 Stratagene mouse embryonic carcinoma (#937317) *Mus musculus* cDNA clone IMAGE:633561 5' similar to gb:D10918 Mouse mRNA for ubiquitin like protein, partial sequence (MOUSE);, mRNA sequence. | *Mus musculus* | 40,426 | 12-Feb.-97 |
| rxa00744 | 1065 | GB_HTG3:AC009855 | 167592 | AC009855 | *Homo sapiens* clone 1_C_5, **** SEQUENCING IN PROGRESS ***, 13 unordered pieces. | *Homo sapiens* | 36,673 | 3-Sep.-99 |
| | | GB_HTG3:AC009855 | 167592 | AC009855 | *Homo sapiens* clone 1_C_5, ***** SEQUENCING IN PROGRESS ***, 13 unordered pieces. | *Homo sapiens* | 36,673 | 3-Sep.-99 |
| rxa00756 | 1119 | GB_PR4:AC005082 | 169739 | AC005082 | *Homo sapiens* clone RG271G13, complete sequence. | *Homo sapiens* | 39,557 | 8-Sep.-99 |
| | | GB_BA1:MLCB596 | 38426 | AL035472 | *Mycobacterium leprae* cosmid B596. | *Mycobacterium leprae* | 54,562 | 27-Aug.-99 |
| | | GB_GSS12:AQ368028 | 652 | AQ368028 | toxb0001N11r CUGI Tomato BAC Library *Lycopersicon esculentum* genomic clone toxb0001N11r, genomic survey sequence. | *Lycopersicon esculentum* | 42,657 | 5-Feb.-99 |
| | | GB_HTG3:AC008067 | 151242 | AC008067 | *Homo sapiens* clone NH030304, **** SEQUENCING IN PROGRESS ***, 2 unordered pieces. | *Homo sapiens* | 37,239 | 8-Sep.-99 |
| rxa00773 | 1266 | GB_BA1:MLU15182 | 40123 | U15182 | *Mycobacterium leprae* cosmid B2266. | *Mycobacterium leprae* | 36,616 | 09-MAR-1995 |
| | | GB_BA1:MSGL611CS | 37769 | L78822 | *Mycobacterium leprae* cosmid L611 DNA sequence. | *Mycobacterium leprae* | 35,714 | 15-Jun.-96 |
| | | GB_GSS14:AQ578181 | 728 | AQ578181 | nbxb0083P08r CUGI Rice BAC Library *Oryza sativa* genomic clone nbxb0083P08r, genomic survey sequence. | *Oryza sativa* | 39,246 | 2-Jun.-99 |
| rxa00793 | 1299 | GB_GSS5:AQ769737 | 519 | AQ769737 | HS_3160_A2_G04_T7C CIT Approved Human Genomic Sperm Library D *Homo sapiens* genomic clone Plate=3160 Col=8 Row=M, genomic survey sequence. | *Homo sapiens* | 37,765 | 28-Jul.-99 |
| | | GB_BA1:RTU08434 | 2400 | U08434 | *Rhizobium trifolii* orotate phosphoribosyltransferase (pyrE) and fructokinase (frk) genes, complete cds. | *Rhizobium trifolii* | 40,700 | 16-Apr.-97 |
| | | GB_EST31:F33810 | 243 | F33810 | HSPD27491 HM3 *Homo sapiens* cDNA clone s3000041E12, mRNA sequence. | *Homo sapiens* | 41,564 | 13-MAY-1999 |
| rxa00820 | 486 | GB_PR4:AC005868 | 96180 | AC005868 | *Homo sapiens* 12q24.2 PAC RPCI5-944M2 (Roswell Park Cancer Institute Human PAC Library) complete sequence. | *Homo sapiens* | 32,298 | 27-Feb.-99 |
| | | GB_EST8:AA000903 | 396 | AA000903 | mg38b04.r1 Soares mouse embryo NbME13.5 14.5 *Mus musculus* cDNA clone IMAGE:426031 5', mRNA sequence. | *Mus musculus* | 42,045 | 18-Jul.-96 |
| | | GB_EST25:AI317789 | 696 | AI317789 | uj20g09.y1 Sugano mouse embryo mewa *Mus musculus* cDNA clone IMAGE:1920544 5' similar to WP:C13C4.5 CE08130 SUGAR TRANSPORTER;, mRNA sequence. | *Mus musculus* | 38,557 | 17-DEC.-1998 |
| rxa00833 | 618 | GB_PH:BPH6589 | 41489 | AJ006589 | Bacteriophage phi-C31 complete genome. | Bacteriophage phi-C31 | 41,806 | 29-Apr.-99 |
| | | GB_HTG2:AC006887 | 215801 | AC006887 | *Caenorhabditis elegans* clone Y59H11, *** SEQUENCING IN PROGRESS ***, 3 unordered pieces. | *Caenorhabditis elegans* | 35,798 | 24-Feb.-99 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00844 | | GB_HTG2:AC006887 | 215801 | AC006887 | *Caenorhabditis elegans* clone Y59H11, *** SEQUENCING IN PROGRESS ***, 3 unordered pieces. | *Caenorhabditis elegans* | 35,798 | 24-Feb.-99 |
| rxa00866 | 957 | GB_GSS15:AQ605195 | 459 | AQ605195 | HS_2136_B1_C12_T7C CIT Approved Human Genomic Sperm Library D *Homo sapiens* genomic clone Plate=2136 Col=23 Row=F, genomic survey sequence. | *Homo sapiens* | 38,074 | 10-Jun.-99 |
| | | GB_HTG1:CNS00M8S | 214599 | AL079302 | *Homo sapiens* chromosome 14 clone R-1089B7, *** SEQUENCING IN PROGRESS ***, in ordered pieces. | *Homo sapiens* | 38,120 | 15-OCT-1999 |
| | | GB_HTG1:CNS00M8S | 214599 | AL079302 | *Homo sapiens* chromosome 14 clone R-1089B7, *** SEQUENCING IN PROGRESS ***, in ordered pieces. | *Homosapiens* | 38,120 | 15-OCT-1999 |
| | 1066 | GB_BA1:CGORF4GEN | 2398 | X95649 | *C.glutamicum* ORF4 gene. | *Corynebacterium glutamicum* | 99,273 | 10-MAR.-1998 |
| | | GB_BA1:BLDAPAB | 3572 | Z21502 | *B.lactofermentum* dapA and dapB genes for dihydrodipicolinate synthase and dihydrodipicolinate reductase. | *Corynebacterium glutamicum* | 99,301 | 16-Aug.-93 |
| | | GB_PAT:E14517 | 1411 | E14517 | DNA encoding *Brevibacterium* dihydrodipicolinic acid reductase. | *Corynebacterium glutamicum* | 99,659 | 28-Jul.-99 |
| rxa00877 | 1788 | GB_PAT:I92050 | 567 | I92050 | Sequence 17 from U.S. Pat. No. 5726299. | Unknown. | 62,787 | 01-DEC.-1998 |
| | | GB_PAT:I78760 | 567 | I78760 | Sequence 16 from U.S. Pat. No. 5693781. | Unknown. | 62,787 | 3-Apr.-98 |
| | | GB_BA2:AE000426 | 10240 | AE000426 | *Escherichia coli* K-12 MG1655 section 316 of 400 of the complete genome. | *Escherichia coli* | 36,456 | 12-Nov.-98 |
| rxa00903 | 733 | GB_BA2:AE001598 | 11136 | AE001598 | *Chlamydia pneumoniae* section 14 of 103 of the complete genome. | *Chlamydophila pneumoniae* | 32,782 | 08-MAR.-1999 |
| | | GB_PL2:AF079370 | 2897 | AF079370 | *Kluyveromyces lactis* invertase (INV1) gene, complete cds. | *Kluyveromyces lactis* | 35,849 | 4-Aug.-99 |
| | | GB_BA2:AE001598 | 11136 | AE001598 | *Chlamydia pneumoniae* section 14 of 103 of the complete genome. | *Chlamydophila pneumoniae* | 40,138 | 08-MAR.-1999 |
| rxa00905 | 924 | GB_PR2:HSQ15C24 | 73192 | AJ239325 | *Homo sapiens* chromosome 21 from cosmids LLNLc116 1C16 and LLNLc116 15C24 map 21q22.3 region D21S171-LA161, complete sequence. | *Homo sapiens* | 35,076 | 28-Sep.-99 |
| | | GB_GSS4:AQ691923 | 446 | AQ691923 | HS_5400_B2_G04_SP6E RPCI-11 Human Male BAC Library *Homo sapiens* genomic clone Plate=976 Col=8 Row=N, genomic survey sequence. | *Homo sapiens* | 33,500 | 6-Jul.-99 |
| | | GB_EST37:AI967802 | 479 | AI967802 | Ljirmpest12-930-d6 Ljirnp Lambda HybriZap two-hybrid library *Lotus japonicus* cDNA clone LP930-12-d6 5' similar to 60S ribosomal protein L7A, mRNA sequence. | *Lotus japonicus* | 41,127 | 24-Aug.-99 |
| rxa00906 | 627 | GB_PAT:I78750 | 588 | I78750 | Sequence 6 from U.S. Pat. No. 5693781. | Unknown. | 97,071 | 3-Apr.-98 |
| | | GB_PAT:I92039 | 588 | I92039 | Sequence 6 from U.S. Pat. No. 5726299. | Unknown. | 97,071 | 01-DEC.-1998 |
| | | GB_PR3:HS929C8 | 139190 | AL020994 | Human DNA sequence from clone 929C8 on chromosome 22q12.1-12.3 Contains CA repeat, GSS, STS, complete sequence. | *Homo sapiens* | 39,016 | 23-Nov.-99 |
| rxa00907 | 246 | GB_PAT:I78750 | 588 | I78750 | Sequence 6 from U.S. Pat. No. 5693781. | Unknown. | 97,561 | 3-Apr.-98 |
| | | GB_PAT:I92039 | 588 | I92039 | Sequence 6 from U.S. Pat. No. 5726299. | Unknown. | 97,561 | 01-DEC.-1998 |
| | | GB_PAT:I78750 | 588 | I78750 | Sequence 6 from U.S. Pat. No. 5693781. | Unknown. | 37,222 | 3-Apr.-98 |
| rxa00961 | 455 | GB_BA1:AB032799 | 9077 | AB032799 | *Chromobacterium violaceum* violacein biosynthetic gene cluster (vio A, vio B, vio C, vio D), complete cds. | *Chromobacterium violaceum* | 39,868 | 02-OCT-1999 |
| | | GB_BA2:AF172851 | 10094 | AF172851 | *Chromobacterium violaceum* violacein biosynthetic gene cluster, complete sequence. | *Chromobacterium violaceum* | 42,760 | 30-Aug.-99 |
| | | GB_BA1:AB032799 | 9077 | AB032799 | *Chromobacterium violaceum* violacein biosynthetic gene cluster (vio A, vio B, vio C, vio D), complete cds. | *Chromobacterium violaceum* | 39,551 | 02-OCT-1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00982 | 1629 | GB_BA1:BLARGS | 2501 | Z21501 | B.lactofermentum argS and lysA genes for arginyl-tRNA synthetase and diaminopimelate decarboxylase (partial). | Corynebacterium glutamicum | 39,003 | 28-DEC.-1993 |
| | | GB_BA1:CGXLYSA | 2344 | X54740 | Corynebacterium glutamicum argS-lysA operon gene for the upstream region of the arginyl-tRNA synthetase and diaminopimelate decarboxylase (EC 4.1.1.20). | Corynebacterium glutamicum | 41,435 | 30-Jun.-93 |
| | | GB_PAT:E14508 | 3579 | E14508 | DNA encoding Brevibacterium diaminopimelic acid decarboxylase and arginyl-tRNA synthase. | Corynebacterium glutamicum | 40,566 | 28-Jul.-99 |
| rxa00983 | 1599 | GB_HTG2:AC008152 | 24000 | AC008152 | Leishmania major chromosome 35 clone L7936 strain Friedlin, *** SEQUENCING IN PROGRESS ***, 4 unordered pieces. | Leishmania major | 38,658 | 28-Jul.-99 |
| | | GB_HTG2:AC008152 | 24000 | AC008152 | Leishmania major chromosome 35 clone L7936 strain Friedlin, *** SEQUENCING IN PROGRESS ***, 4 unordered pieces. | Leishmania major | 38,658 | 28-Jul.-99 |
| | | GB_HTG3:AC008648 | 87249 | AC008648 | Homo sapiens chromosome 5 clone CIT978SKB_186E14, *** SEQUENCING IN PROGRESS ***, 22 unordered pieces. | Homo sapiens | 36,102 | 3-Aug.-99 |
| rxa00984 | 440 | GB_BA1:MVINED | 3098 | D01045 | Micromonospora viridifaciens DNA for nedR protein and neuraminidase, complete cds. | Micromonospora viridifaciens | 59,226 | 2-Feb.-99 |
| | | GB_PAT:E02375 | 1881 | E02375 | Neuraminidase gene. | Micromonospora viridifaciens | 59,226 | 29-Sep.-97 |
| | | GB_PR4:HUAC004513 | 101311 | AC004513 | Homo sapiens Chromosome 16 BAC clone CIT987SK-A-926E7, complete sequence. | Homo sapiens | 41,204 | 23-Nov.-99 |
| rxa01014 | 2724 | GB_BA1:MTV008 | 63033 | AL021246 | Mycobacterium tuberculosis H37Rv complete genome; segment 108/162. | Mycobacterium tuberculosis | 56,167 | 17-Jun.-98 |
| | | GB_BA1:STMAMPEPN | 2849 | L23172 | Streptomyces lividans aminopeptidase N gene, complete cds. | Streptomyces lividans | 57,067 | 18-MAY-1994 |
| | | GB_BA1:SC7H2 | 42655 | AL109732 | Streptomyces coelicolor cosmid 7H2. | Streptomyces coelicolor A3(2) | 37,551 | 2-Aug.-99 |
| rxa01059 | 732 | GB_HTG3:AC008154 | 172241 | AC008154 | Homo sapiens chromosome 7, *** SEQUENCING IN PROGRESS ***, 26 unordered pieces. | Homo sapiens | 39,499 | 8-Sep.-99 |
| | | GB_HTG3:AC008154 | 172241 | AC008154 | Homo sapiens chromosome 7, *** SEQUENCING IN PROGRESS ***, 26 unordered pieces. | Homo sapiens | 39,499 | 8-Sep.-99 |
| | | GB_EST32:AI756574 | 299 | AI756574 | ea02f10.y1 Eimeria M5-6 Merozoite stage Eimeria tenella cDNA 5', mRNA sequence. | Eimeria tenella | 37,793 | 23-Jun.-99 |
| rxa01073 | 954 | GB_BA1:BACOUTB | 1004 | M15811 | Bacillus subtilis outB gene encoding a sporulation protein, complete cds. | Bacillus subtilis | 53,723 | 26-Apr.-93 |
| | | GB_PR4:AC007938 | 167237 | AC007938 | Homo sapiens clone UWGC:djs201 from 7q31, complete sequence. | Homo sapiens | 34,322 | 1-Jul.-99 |
| | | GB_PL2:ATAC006282 | 92577 | AC006282 | Arabidopsis thaliana chromosome II BAC F13K3 genomic sequence, complete sequence. | Arabidopsis thaliana | 36,181 | 13-MAR.-1999 |
| rxa01120 | 1401 | GB_BA1:MTV008 | 63033 | AL021246 | Mycobacterium tuberculosis H37Rv complete genome; segment 108/162. | Mycobacterium tuberculosis | 36,715 | 17-Jun.-98 |
| | | GB_BA1:CAJ10321 | 6710 | AJ010321 | Caulobacter crescentus partial tig gene and clpP, cicA, clpX, ion genes. | Caulobacter crescentus | 63,311 | 01-OCT-1998 |
| | | GB_BA2:AF150957 | 4440 | AF150957 | Azospirillum brasilense trigger factor (tig), heat-shock protein ClpP (clpP), and heat-shock protein ClpX (clpX) genes, complete cds; and Lon protease (ion) gene, partial cds. | Azospirillum brasilense | 60,613 | 7-Jun.-99 |
| rxa01147 | 1383 | GB_PR3:HS408N23 | 97916 | Z98048 | Human DNA sequence from PAC 408N23 on chromosome 22q13. Contains HIP, HSC70-INTERACTING PROTEIN (PROGESTERONE RECEPTOR-ASSOCIATED P48 PROTEIN), ESTs and STS. | Homo sapiens | 34,567 | 23-Nov.-99 |
| | | GB_BA2:AE001227 | 26849 | AE001227 | Treponema pallidum section 43 of 87 of the complete genome. | Treponema pallidum | 37,564 | 16-Jul.-98 |
| | | GB_PR3:HS408N23 | 97916 | Z98048 | Human DNA sequence from PAC 408N23 on chromosome 22q13. | Homo sapiens | 34,911 | 23-Nov.-99 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01151 | 958 | | | | Contains HIP, HSC70-INTERACTING PROTEIN (PROGESTERONE RECEPTOR-ASSOCIATED P48 PROTEIN), ESTs and STS. | | | |
| | | GB_BA1:MTCY261 | 27322 | Z97559 | Mycobacterium tuberculosis H37Rv complete genome; segment 95/162. | Mycobacterium tuberculosis | 38,789 | 17-Jun.-98 |
| | | GB_HTG4:AC009849 | 114993 | AC009849 | Drosophila melanogaster chromosome 2 clone BACR07H08 (D864) RPCI-98 07.H.8 map 31B–31C strain y; cn bw sp, **** SEQUENCING IN PROGRESS ****, 55 unordered pieces. | Drosophila melanogaster | 39,213 | 25-OCT-1999 |
| | | GB_HTG4:AC009849 | 114993 | AC009849 | Drosophila melanogaster chromosome 2 clone BACR07H08 (D864) RPCI-98 07.H.8 map 31B–31C strain y; cn bw sp, **** SEQUENCING IN PROGRESS ****, 55 unordered pieces. | Drosophila melanogaster | 39,213 | 25-OCT-1999 |
| rxa01161 | 1260 | GB_BA2:AF176799 | 2943 | AF176799 | Lactobacillus pentosus PepP (pepP) and catabolite control protein A (ccpA) genes, complete cds. | Lactobacillus pentosus | 37,043 | 5-Sep.-99 |
| | | GB_BA2:AF012O84 | 3082 | AF012084 | Lactobacillus helveticus prolidase (pepQ) gene, complete cds. | Lactobacillus helveticus | 46,796 | 1-Jul.-98 |
| | | GB_EST32:A1728955 | 611 | AI728955 | BNLGHi2114 Six-day Cotton fiber Gossypium hirsutum cDNA 5' similar to (AC004481) putative permease [Arabidopsis thaliana], mRNA sequence. | Gossypium hirsutum | 37,647 | 11-Jun.-99 |
| rxa01181 | 980 | GB_BA1:MLCB22 | 40281 | Z98741 | Mycobacterium leprae cosmid B22. | Mycobacterium leprae | 61,570 | 22-Aug.-97 |
| | | GB_BA1:MTCY190 | 34150 | Z70283 | Mycobacterium tuberculosis H37Rv complete genome; segment 98/162. | Mycobacterium tuberculosis | 60,434 | 17-Jun.-98 |
| | | GB_BA1:SC5F7 | 40024 | AL096872 | Streptomyces coelicolor cosmid 5F7. | Streptomyces coelicolor A3(2) | 57,011 | 22-Jul.-99 |
| rxa01182 | 516 | GB_HTG1:CEY116A8_2 | 110000 | Z98858 | Caenorhabditis elegans chromosome IV clone Y116A8, *** SEQUENCING IN PROGRESS ***, in unordered pieces. | Caenorhabditis elegans | 34,843 | 26-Oct-99 |
| | | GB_HTG1:CEY116A8_2 | 110000 | Z98858 | Caenorhabditis elegans chromosome IV clone Y116A8, *** SEQUENCING IN PROGRESS ***, in unordered pieces. | Caenorhabditis elegans | 34,843 | 26-Oct.-99 |
| rxa01189 | 732 | GB_IN1:CEY116A8C | 260341 | AL117204 | Caenorhabditis elegans cosmid Y116A8C, complete sequence. | Caenorhabditis elegans | 34,843 | 19-Nov.-99 |
| | | GB_BA1:D90915 | 130001 | D90915 | Synechocystis sp. PCC6803 complete genome, 17/27, 2137259–2267259. | Synechocystis sp. | 36,538 | 7-Feb.-99 |
| | | GB_BA1:D90915 | 130001 | D90915 | Synechocystis sp. PCC6803 complete genome, 17/27, 2137259–2267259. | Synechocystis sp. | 34,512 | 7-Feb.-99 |
| | | GB_HTG3:AC010515 | 41038 | AC010515 | Homo sapiens chromosome 19 clone LLNL-R_249H9, *** SEQUENCING IN PROGRESS ***, 31 unordered pieces. | Homo sapiens | 33,564 | 15-Sep.-99 |
| rxa01192 | 681 | GB_OM:CFP180RRC | 5425 | X87224 | Canis familiaris mRNA for ribosome receptor, p180. | Canis familiaris | 41,229 | 22-Jan.-99 |
| | | GB_OM:CFP180RRC | 5425 | X87224 | Canis familiaris mRNA for ribosome receptor, p180. | Canis familiaris | 38,187 | 22-Jan.-99 |
| rxa01214 | 1614 | GB_IN1:CEY47D3A | 199814 | AL117202 | Caenorhabditis elegans cosmid Y47D3A, complete sequence. | Caenorhabditis elegans | 36,604 | 19-Nov.-99 |
| | | GB_PR4:AC006039 | 176257 | AC006039 | Homo sapiens clone NH0319F03, complete sequence. | Homo sapiens | 34,984 | 05-MAY-1999 |
| | | GB_PR4:AC006039 | 176257 | AC006039 | Homo sapiens clone NH0319F03, complete sequence. | Homo sapiens | 35,951 | 05-MAY-1999 |
| rxa01224 | 1146 | GB_EST22:AI070047 | 479 | AI070047 | UI-R-C1-In-f-08-0-UI.s1 UI-R-C1 Rattus norvegicus cDNA clone UI-R-C1-In-f-08-0-UI 3', mRNA sequence. | Rattus norvegicus | 36,975 | 5-Jul.-99 |
| | | GB_RO:S75965 | 625 | S75965 | THP=Tamm-Horsfall protein {promoter} [rats, Genomic, 625 nt]. | Rattus sp. | 34,400 | 27-Jul.-95 |
| | | GB_EST5:H96951 | 459 | H96951 | yu01g03.r1 Soares_pineal_gland_N3HPG Homo sapiens cDNA clone IMAGE:232564 5', mRNA sequence. | Homo sapiens | 32,969 | 11-DEC.-1995 |
| rxa01250 | 588 | GB_PL1:NEU1CCB | 2656 | M18334 | N.crassa (strain TS) laccase gene, complete cds. | Neurospora crassa | 44,330 | 03-MAY-1994 |
| | | GB_OV:MITRACOMPL | 16714 | Y16884 | Rhea americana complete mitochondrial genome. | Mitochondrion Rhea americana | 35,094 | 19-Jul.-99 |
| | | GB_OV:AF090339 | 16704 | AF090339 | Rhea americana mitochondrion, complete genome. | Mitochondrion Rhea americana | 35,094 | 27-MAY-1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01277 | 2127 | GB_PL2:AF111709 | 52684 | AF111709 | Oryza sativa subsp. indica Retrosat 1 retrotransposon and Ty3-Gypsy type Retrosat 2 retrotransposon, complete sequences; and unknown genes. | Oryza sativa subsp. indica | 37,410 | 26-Apr.-99 |
| | | GB_IN1:CELZC250 | 34372 | AF003383 | Caenorhabditis elegans cosmid ZC250. | Caenorhabditis elegans | 35,506 | 14-MAY-1997 |
| | | GB_EST1:Z14808 | 331 | Z14808 | CEL5E4 Chris Martin sorted cDNA library Caenorhabditis elegans cDNA clone cm5e4 5', mRNA sequence. | Caenorhabditis elegans | 36,890 | 19-Jun.-97 |
| rxa01302 | 576 | GB_BA1:MTCI65 | 34331 | Z95584 | Mycobacterium tuberculosis H37Rv complete genome; segment 50/162. | Mycobacterium tuberculosis | 59,298 | 17-Jun.-98 |
| | | GB_BA1:MSGY348 | 40056 | AD000020 | Mycobacterium tuberculosis sequence from clone y348. | Mycobacterium tuberculosis | 59,227 | 10-DEC.-1996 |
| rxa01303 | 1458 | GB_BA1:SC5C7 | 41906 | AI031515 | Streptomyces coelicolor cosmid 5C7. | Streptomyces coelicolor | 39,261 | 7-Sep.-98 |
| | | GB_BA1:TTAJ5043 | 837 | AJ225043 | Thermus thermophilus partial narK gene. | Thermus thermophilus | 55,245 | 18-Jun.-98 |
| | | GB_PL2:AC010675 | 84723 | AC010675 | Arabidopsis thaliana chromosome I BAC T17F3 genomic sequence, complete sequence. | Arabidopsis thaliana | 37,058 | 11-Nov.-99 |
| | | GB_GSS9:AQ170862 | 518 | AQ170862 | HS_3165_B2_F03_T7 CIT Approved Human Genomic Sperm Library D Homo sapiens genomic clone Plate=3165 Col=6 Row=L, genomic survey sequence. | Homo sapiens | 38,610 | 17-OCT-1998 |
| rxa01308 | 2503 | GB_BA1:D90757 | 17621 | D90757 | Escherichia coli genomic DNA. (27.3–27.7 min). | Escherichia coli | 55,445 | 7-Feb.-99 |
| | | GB_BA1:D90787 | 15942 | D90787 | E.coli genomic DNA, Kohara clone #276(33.0–33.3 min.) | Escherichia coli | 36,815 | 29-MAY-1997 |
| | | GB_BA1:D90758 | 13860 | D90758 | Escherichia coli genomic DNA. (27.6–27.9 min). | Escherichia coli | 54,942 | 7-Feb.-99 |
| rxa01309 | 824 | GB_BA1:SCI12 | 35302 | AL109989 | Streptomyces coelicolor cosmid J12. | Streptomyces coelicolor A3(2) | 62,423 | 24-Aug.-99 |
| | | GB_BA1:BSNARYWI | 12450 | Z49884 | B.subtilis nar[G, H, I, J, K], ywi[C, D ,E] and argS genes. | Bacillus subtilis | 57,447 | 24-Jun.-98 |
| | | GB_BA1:BSUB0020 | 212150 | Z99123 | Bacillus subtilis complete genome (section 20 of 21): from 3798401 to 4010550. | Bacillus subtilis | 37,129 | 26-Nov.-97 |
| rxa01358 | 1644 | GB_GSS11:AQ260413 | 453 | AQ260413 | CITBI-E1-2510B12.TF CITBI-E1 Homo sapiens genomic clone 2510B12, genomic survey sequence. | Homo sapiens | 41,531 | 24-OCT-1998 |
| | | GB_EST20:AA840582 | 326 | AA840582 | vw77h07.r1 Stratagene mouse heart (#937316) Mus musculus cDNA clone IMAGE:1261021 5' similar to gb:J04181 Mouse A–X actin mRNA, complete cds (MOUSE); mRNA sequence. | Mus musculus | 42,901 | 27-Feb.-98 |
| rxa01385 | 2004 | GB_PAT:A39944 | 3836 | A39944 | Sequence 1 from Patent WO9421807. | unidentified | 38,764 | 05-MAR-1997 |
| | | GB_BA1:FVBPENTA | 2519 | M98557 | Flavobacterium sp. pentachlorophenol 4-monooxygenase gene, complete mRNA. | Flavobacterium sp. | 40,855 | 26-Apr-93 |
| | | GB_PAT:I19994 | 2516 | I19994 | Sequence 2 from U.S. Pat. No. 5512478. | Unknown. | 40,855 | 07-OCT-1996 |
| | | GB_BA2:AF059680 | 2410 | AF059680 | Sphingomonas sp. UG30 pentachlorophenol 4-monooxygenase (pcpB) gene, complete cds; and pentachlorophenol 4-monooxygenase reductase (pcpD) gene, partial cds. | Sphingomonas sp. UG30 | 42,993 | 27-Apr-99 |
| rxa01412 | 327 | GB_GSS12:AQ332469 | 459 | AQ332469 | HS_5003_A1_H08_SP6E RPCI11 Human Male BAC Library Homo sapiens genomic clone Plate=579 Col=15 Row=O, genomic survey sequence. | Homo sapiens | 38,208 | 06-MAR-1999 |
| | | GB_EST27:AA998532 | 453 | AA998532 | UI-R-C0-ic-d-11-0-UI.s1 UI-R-C0 Rattus norvegicus cDNA clone UI-R-C0-ic-d-11-0-UI 3', mRNA sequence. | Rattus norvegicus | 39,336 | 09-MAR-1999 |
| | | GB_HTG1:HSA342D11 | 178183 | AL121748 | Homo sapiens chromosome 10 clone RP11-342D11, *** SEQUENCING IN PROGRESS ***, in unordered pieces. | Homo sapiens | 40,550 | 23-Nov.-99 |
| rxa01458 | 1173 | GB_BA2:AE000745 | 15085 | AE000745 | Aquifex aeolicus section 77 of 109 of the complete genome. | Aquifex aeolicus | 37,694 | 25-MAR-1998 |
| | | GB_BA2:AE000745 | 15085 | AE000745 | Aquifex aeolicus section 77 of 109 of the complete genome. | Aquifex aeolicus | 35,567 | 25-MAR-1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01571 | 723 | GB_BA1:AB011413 | 12070 | AB011413 | *Streptomyces griseus* genes for Orf2, Orf3, Orf4, Orf5, AfsA, Orf8, partial and complete cds. | *Streptomyces griseus* | 57,500 | 7-Aug.-98 |
| | | GB_BA1:AB011413 | 12070 | AB011413 | *Streptomyces griseus* genes for Orf2, Orf3, Orf4, Orf5, AfsA, Orf8, partial and complete cds. | *Streptomyces griseus* | 35,655 | 7-Aug.-98 |
| rxa01607 | 753 | GB_PR4:AC005005 | 133893 | AC005005 | *Homo sapiens* PAC clone DJ412A9 from 22, complete sequence. | *Homo sapiens* | 38,399 | 02-MAR-1999 |
| | | GB_HTG3:AC008257 | 109187 | AC008257 | *Drosophila melanogaster* chromosome 2 clone BACR08A11 (D916) RPCI-98 08.A.11 map 42A—42A strain y; cn bw sp; *** SEQUENCING IN PROGRESS ***; 93 unordered pieces. | *Drosophila melanogaster* | 33,741 | 08-OCT-1999 |
| | | GB_HTG3:AC008257 | 109187 | AC008257 | *Drosophila melanogaster* chromosome 2 clone BACR08A11 (D916) RPCI-98 08.A.11 map 42A—42A strain y; cn bw sp; *** SEQUENCING IN PROGRESS ***; 93 unordered pieces. | *Drosophila melanogaster* | 33,741 | 08-OCT-1999 |
| rxa01609 | 996 | GB_BA1:MTV003 | 13246 | AL008883 | *Mycobacterium tuberculosis* H37Rv complete genome; segment 125/162. | *Mycobacterium tuberculosis* | 39,369 | 17-Jun.-98 |
| | | GB_BA1:MSGB1529CS | 36985 | L78824 | *Mycobacterium leprae* cosmid B1529 DNA sequence. | *Mycobacterium leprae* | 60,624 | 15-Jun.-96 |
| | | GB_BA1:AB024601 | 14807 | AB024601 | *Pseudomonas aeruginosa* dapD gene for tetrahydrodipicolinate N-succinyletransferase, complete cds, strain PAO1. | *Pseudomonas aeruginosa* | 41,603 | 12-MAR-1999 |
| rxa01654 | 1119 | GB_GSS4:AQ704352 | 532 | AQ704352 | HS_2147_A2_H04_MR CIT Approved Human Genomic Sperm Library D *Homo sapiens* genomic clone Plate=2147 Col=8 Row=O, genomic survey sequence. | *Homo sapiens* | 37,838 | 7-Jul.-99 |
| | | GB_RO:MMAE000663 | 250611 | AE000663 | *Mus musculus* TCR beta locus from bases 1 to 250611 (section 1 of 3) of the complete sequence. | *Mus musculus* | 35,799 | 4-Sep.-97 |
| | | GB_EST23:AI158428 | 511 | AI158428 | ud24f12.r1 Soares 2NbMT *Mus musculus* cDNA clone IMAGE:1446863 5', mRNA sequence. | *Mus musculus* | 41,337 | 30-Sep.-98 |
| rxa01664 | 945 | GB_OV:AF026198 | 63155 | AF026198 | *Fugu rubripes* neural cell adhesion molecule L1 homolog (L1-CAM) gene, complete cds; putative protein 1 (PUT1) gene, partial cds; mitosis-specific chromosome segregation protein SMC1 homolog (SMC1) gene, complete cds; and calcium channel alpha-1 subunit homolog (CCA1) and putative protein 2 (PUT2) genes, partial cds, complete sequence. | *Fugu rubripes* | 35,187 | 02-MAY-1998 |
| | | GB_PR3:AC004466 | 122186 | AC004466 | *Homo sapiens* 12q13.1 PAC RPCI5-1057I20 (Roswell Park Cancer Institute Human PAC library) complete sequence. | *Homo sapiens* | 37,382 | 17-Sep.-98 |
| | | GB_PR3:AC004466 | 122186 | AC004466 | *Homo sapiens* 12q13.1 PAC RPCI5-1057I20 (Roswell Park Cancer Institute Human PAC library) complete sequence. | *Homo sapiens* | 37,325 | 17-Sep.-98 |
| rxa01795 | 720 | GB_BA2:CGU13922 | 4412 | U13922 | *Corynebacterium glutamicum* putative type II 5-cytosoine methyltransferase (cgIIM) and putative type II restriction endonuclease (cgIIR) and putative type I or type III restriction endonuclease (cIgIIR) genes, complete cds. | *Corynebacterium glutamicum* | 99,444 | 3-Feb.-98 |
| | | GB_BA1:S86113 | 1044 | S86113 | ORF 1 [*Neisseria gonorrhoeae*, Genomic, 1044 nt]. | *Neisseria gonorrhoeae* | 58,320 | 07-MAY-1993 |
| | | GB_PAT:I22080 | 850 | I22080 | Sequence 1 from U.S. Pat. No. 5525717. | Unknown. | 57,722 | 07-OCT-1996 |
| rxa01802 | 954 | GB_BA2:AE001519 | 14062 | AE001519 | *Helicobacter pylori*, strain J99 section 80 of 132 of the complete genome. | *Helicobacter pylori* J99 | 33,510 | 20-Jan.-99 |
| rxa01838 | 842 | GB_GSS5:AQ774071 | 552 | AQ774071 | HS_2269_B1_C10_T7C CIT Approved Human Genomic Sperm Library D *Homo sapiens* genomic clone Plate=2269 Col=19 Row=F, genomic survey sequence. | *Homo sapiens* | 37,967 | 29-Jul.-99 |
| | | GB_PR4:AC007459 | 40907 | AC007459 | *Homo sapiens* chromosome 16 clone 306C6, complete sequence. | *Homo sapiens* | 39,140 | 04-MAY-1999 |
| | | GB_BA1:SCE15 | 26440 | AL049707 | *Streptomyces coelicolor* cosmid E15. | *Streptomyces coelicolor* | 36,297 | 22-Apr.-99 |
| | | GB_HTG3:AC009545 | 165042 | AC009545 | *Homo sapiens* chromosome 11 clone 131_J_04 map 11, *** | *Homo sapiens* | 37,651 | 01-OCT-1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01848 | 867 | GB_HTG3:AC009545 | 165042 | AC009545 | SEQUENCING IN PROGRESS ***, 8 unordered pieces. Homo sapiens chromosome 11 clone 131_J_04 map 11, *** SEQUENCING IN PROGRESS ***, 8 unordered pieces. | Homo sapiens | 37,651 | 01-OCT-1999 |
| | | GB_BA1:MTCY24A1 | 20270 | Z95207 | Mycobacterium tuberculosis H37Rv complete genome; segment 124/162. | Mycobacterium tuberculosis | 38,270 | 17-Jun.-98 |
| | | GB_EST21:C89252 | 587 | C89252 | C89252 Mouse early blastocyst cDNA Mus musculus cDNA clone 01B00061J1C08, mRNA sequence. | Mus musculus | 37,219 | 28-MAY-1998 |
| | | GB_EST14:AA423340 | 457 | AA423340 | ve39d04.r1 Soares mouse mammary gland NbMMG Mus musculus cDNA clone IMAGE:820519 5', mRNA sequence. | Mus musculus | 38,377 | 16-OCT-1997 |
| rxa01849 | 1224 | GB_BA1:MTCY24A1 | 20270 | Z95207 | Mycobacterium tuberculosis H37Rv complete genome; segment 124/162. | Mycobacterium tuberculosis | 39,950 | 17-Jun.-98 |
| | | GB_BA2:RCPHSYNG | 45959 | Z11165 | R.capsulatus complete photosynthesis gene cluster. | Rhodobacter capsulatus | 37,344 | 2-Sep.-99 |
| | | GB_BA1:RSP010302 | 40707 | AJ010302 | Rhodobacter sphaeroides photosynthetic gene cluster. | Rhodobacter sphaeroides | 40,898 | 27-Aug.-99 |
| rxa01868 | 2049 | GB_BA1:MTV033 | 21620 | AL021928 | Mycobacterium tuberculosis H37Rv complete genome; segment 11/162. | Mycobacterium tuberculosis | 38,679 | 17-Jun.-98 |
| | | GB_BA1:MLCL622 | 42498 | Z95398 | Mycobacterium leprae cosmid L622. | Mycobacterium leprae | 38,911 | 24-Jun.-97 |
| | | GB_BA1:MSGB983CS | 36788 | L78828 | Mycobacterium leprae cosmid B983 DNA sequence. | Mycobacterium leprae | 38,933 | 15-Jun.-96 |
| rxa01885 | 924 | GB_BA1:MTCY1A10 | 25949 | Z95387 | Mycobacterium tuberculosis H37Rv complete genome; segment 117/162. | Mycobacterium tuberculosis | 51,094 | 17-Jun.-98 |
| | | GB_PR3:HSU220B11 | 41247 | Z69908 | Human DNA sequence from cosmid cU220B11, between markers DXS6791 and DXS8038 on chromosome X. | Homo sapiens | 39,038 | 23-Nov.-99 |
| | | GB_BA1:PDU17435 | 993 | U17435 | Paracoccus denitrificans Fnr-like transcriptional activator (nnr) gene, complete cds. | Paracoccus denitrificans | 39,390 | 19-Jul.-95 |
| rxa01914 | 526 | GB_PR3:AC005796 | 43843 | AC005796 | Homo sapiens chromosome 19, cosmid R31408, complete sequence. | Homo sapiens | 34,961 | 06-OCT-1998 |
| | | GB_PR3:HS390C10 | 114231 | AL008721 | Homo sapiens DNA sequence from BAC 390C10 on chromosome 22q11.21-12.1. Contains an Immunoglobulin LIKE gene and a pseudogene similar to Beta Crystallin. Contains ESTs, STSs, GSSs and taga and tat repeat polymorphisms, complete sequence. | Homo sapiens | 39,600 | 23-Nov.-99 |
| rxa01932 | 1020 | GB_PR3:AC005796 | 43843 | AC005796 | Homo sapiens chromosome 19, cosmid R31408, complete sequence. | Homo sapiens | 37,725 | 06-OCT-1998 |
| | | GB_PR3:AC003025 | 112309 | AC003025 | Human Chromosome 11p12.2 PAC clone pDJ466a11, complete sequence. | Homo sapiens | 35,585 | 23-Jul.-98 |
| | | GB_GSS3:B78728 | 312 | B78728 | CIT-HSP-431E3.TV CIT-HSP Homo sapiens genomic clone 431E3, genomic survey sequence. | Homo sapiens | 38,907 | 25-Jun.-98 |
| rxa01933 | 726 | GB_PR3:AC003025 | 112309 | AC003025 | Human Chromosome 11p12.2 PAC clone pDJ466a11, complete sequence. | Homo sapiens | 35,859 | 23-Jul.-98 |
| | | GB_HTG1:HS74O16 | 169401 | AL110119 | Homo sapiens chromosome 21 clone RPCIP704O1674 map 21q21, *** SEQUENCING IN PROGRESS ***, in unordered pieces. | Homo sapiens | 35,302 | 27-Aug.-99 |
| | | GB_HTG1:HS74O16 | 169401 | AL110119 | Homo sapiens chromosome 21 clone RPCIP704O1674 map 21q21, *** SEQUENCING IN PROGRESS ***, in unordered pieces. | Homo sapiens | 35,302 | 27-Aug.-99 |
| rxa01971 | 954 | GB_PR4:AC006032 | 170282 | AC006032 | Homo sapiens BAC clone NHO115E20 from Y, complete sequence. | Homo sapiens | 37,640 | 27-Feb.-99 |
| | | GB_HTG3:AC008230 | 108469 | AC008230 | Drosophila melanogaster chromosome 2 clone BACR17I17 (D934) RPCI-98 17.I.17 map 53A–53C strain y; cn bw sp, *** SEQUENCING IN PROGRESS ***, 108 unordered pieces. | Drosophila melanogaster | 35,466 | 10-Aug.-99 |
| | | GB_HTG3:AC008230 | 108469 | AC008230 | Drosophila melanogaster chromosome 2 clone BACR17I17 (D934) RPCI-98 17.I.17 map 53A–53C strain y; cn bw sp, *** SEQUENCING IN PROGRESS ***, 108 unordered pieces. | Drosophila melanogaster | 35,466 | 10-Aug.-99 |
| | | GB_PR3:AF064860 | 165382 | AF064860 | Homo sapiens chromosome 21q22.3 PAC 70124, complete sequence. | Homo sapiens | 39,716 | 2-Jun.-98 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02016 | 900 | GB_EST2:D48846 | 459 | D48846 | RICS15292A Rice green shoot *Oryza sativa* cDNA, mRNA sequence. | *Oryza sativa* | 37,118 | 2-Aug-95 |
| | | GB_GSS10:AQ195886 | 595 | AQ195886 | RPCI11-66O13.TJ RPCI-11 *Homo sapiens* genomic clone RPCI-11-66O13, genomic survey sequence. | *Homo sapiens* | 41,000 | 20-Apr-99 |
| | | GB_GSS10:AQ195886 | 595 | AQ195886 | RPCI11-66O13.TJ RPCI-11 *Homo sapiens* genomic clone RPCI-11-66O13, genomic survey sequence. | *Homo sapiens* | 34,790 | 20-Apr-99 |
| rxa02017 | 807 | GB_EST20:AA855266 | 406 | AA855266 | vw70b08.r1 Stratagene mouse heart (#937316) *Mus musculus* cDNA clone IMAGE:1260279 5', mRNA sequence. | *Mus musculus* | 42,638 | 06-MAR-1998 |
| | | GB_EST20:AA855266 | 406 | AA855266 | vw70b08.r1 Stratagene mouse heart (#937316) *Mus musculus* cDNA clone IMAGE:1260279 5', mRNA sequence. | *Mus musculus* | 37,183 | 06-MAR-1998 |
| rxa02018 | 1073 | GB_BA1:SCSC7 | 41906 | AL031515 | *Streptomyces coelicolor* cosmid 5C7. | *Streptomyces coelicolor* | 41,732 | 7-Sep-98 |
| | | GB_BA1:MTCI65 | 34331 | Z95584 | *Mycobacterium tuberculosis* H37Rv complete genome; segment 50/162. | *Mycobacterium tuberculosis* | 62,395 | 17-Jun-98 |
| | | GB_BA1:SCI12 | 35302 | AL109989 | *Streptomyces coelicolor* cosmid J12. | *Streptomyces coelicolor* | 61,603 | 24-Aug-99 |
| rxa02048 | 1497 | GB_PAT:E15823 | 2323 | E15823 | DNA encoding cell surface protein from *Corynebacterium ammoniagenes*. | *Corynebacterium ammoniagenes* | 53,942 | 28-Jul-99 |
| | | GB_OM:SSAMPTDN | 3387 | Z29522 | *S.scrofa* mRNA for aminopeptidase N. | *Sus scrofa* | 42,672 | 26-Sep-94 |
| | | GB_OV:D87992 | 3181 | D87992 | *Gallus gallus* mRNA for aminopeptidase Ey, complete cds. | *Gallus gallus* | 41,554 | 5-Jun-99 |
| rxa02101 | 1386 | GB_BA1:AP000064 | 247695 | AP000064 | *Aeropyrum pernix* genomic DNA, section 7/7. | *Aeropyrum pernix* | 39,882 | 22-Jun-99 |
| | | GB_PL2:ATAC006587 | 79262 | AC006587 | *Arabidopsis thaliana* chromosome II BAC T17D12 genomic sequence, complete sequence. | *Arabidopsis thaliana* | 38,490 | 23-MAR-1999 |
| | | GB_PL2:ATAC006587 | 79262 | AC006587 | *Arabidopsis thaliana* chromosome II BAC T17D12 genomic sequence, complete sequence. | *Arabidopsis thaliana* | 34,863 | 23-MAR-1999 |
| rxa02265 | 423 | GB_BA2:AF120718 | 4137 | AF120718 | *Lactobacillus fermentum* urease operon, partial sequence. | *Lactobacillus fermentum* | 56,265 | 31-MAR-1999 |
| | | GB_PAT:E03531 | 2896 | E03531 | DNA sequence coding for acid urease. | *Lactobacillus fermentum* | 56,265 | 29-Sep-97 |
| | | GB_BA1:LBAAURE | 2896 | D10605 | *L.fermentum* gene for acid urease. | *Lactobacillus fermentum* | 56,265 | 2-Feb-99 |
| rxa02276 | 801 | GB_GSS10:AQ242920 | 451 | AQ242920 | HS_2061_A1_E08_MR CIT Approved Human Genomic Sperm Library D *Homo sapiens* genomic clone Plate=2061 Col=15 Row=I, genomic survey sequence. | *Homo sapiens* | 37,916 | 03-OCT-1998 |
| | | GB_IN1:SLMMTPMF | 14503 | D29637 | *Physarum polycephalum* mitochondrial DNA. | Mitochondrion *Physarum polycephalum* | 40,335 | 12-MAY-1999 |
| | | GB_IN2:AF012249 | 5542 | AF012249 | *Physarum polycephalum* strain aux2-S region of mitochondria derived from mF plasmid, including URFA', URFC, URFD, URFE, URFF, and URFG genes, complete cds and URFH gene, partial cds. | Mitochondrion *Physarum polycephalum* | 40,335 | 08-MAY-1998 |
| rxa02277 | 738 | GB_BA2:AF048784 | 681 | AF048784 | *Actinomyces naeslundii* urease accessory protein (ureG) gene, complete cds. | *Actinomyces naeslundii* | 66,814 | 9-Feb-99 |
| | | GB_BA2:AF056321 | 5482 | AF056321 | *Actinomyces naeslundii* urease gamma subunit UreA (ureA), urease beta subunit UreB (ureB), urease alpha subunit UreC (ureC), urease accessory protein UreE (ureE), urease accessory protein UreF (ureF), urease accessory protein UreG (ureG), and urease accessory protein UreD (ureD) genes, complete cds. | *Actinomyces naeslundii* | 63,686 | 9-Feb-99 |
| | | GB_BA2:SSU35248 | 5773 | U35248 | *Streptococcus salivarius* ure cluster nickel transporter homolog (urel) gene, partial cds, and urease beta subunit (ureA), gamma subunit (ureB), alpha subunit (ureC), and accessory proteins (ureE), (ureF), (ureG), and (ureD) genes, complete cds. | *Streptococcus salivarius* | 61,931 | 26-Jan-96 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02278 | 972 | GB_GSS3:B49054 | 543 | B49054 | RPCI11-4I13.TV RPCI-11 Homo sapiens genomic clone RPCI-11-4I13, genomic survey sequence. | Homo sapiens | 39,161 | 8-Apr.-99 |
| | | GB_PL1:PMCMSGI | 3363 | L27092 | Pneumocystis carinii B-cell receptor (msg) gene, 3' end. | Pneumocystis carinii | 39,819 | 26-Sep.-94 |
| | | GB_PL2:AF038556 | 12792 | AF038556 | Pneumocystis carinii f. sp. hominis variant regions of major surface glycoproteins (msg1, msg3, msg4) genes, partial cds. | Pneumocystis carinii f. sp. hominis | 33,832 | 10-Sep.-98 |
| rxa02317 | 735 | GB_GSS8:AQ051031 | 914 | AQ051031 | nbxb0004dG10r CUGI Rice BAC Library Oryza sativa genomic clone nbxb0004N20r, genomic survey sequence. | Oryza sativa | 32,299 | 24-MAR.-1999 |
| | | GB_GSS8:AQ051031 | 914 | AQ051031 | nbxb0004dG10r CUGI Rice BAC Library Oryza sativa genomic clone nbxb0004N20r, genomic survey sequence. | Oryza sativa | 34,573 | 24-MAR.-1999 |
| rxa02334 | 746 | GB_BA1:CGU35023 | 3195 | U35023 | Corynebacterium glutamicum thiosulfate sulfurtransferase (thtR) gene, partial cds, acyl CoA carboxylase (accBC) gene, complete cds. | Corynebacterium glutamicum | 100,000 | 16-Jan.-97 |
| | | GB_BA1:MTCY71 | 42729 | Z92771 | Mycobacterium tuberculosis H37Rv complete genome; segment 141/162. | Mycobacterium tuberculosis | 60,380 | 10-Feb.-99 |
| | | GB_BA1:U00012 | 33312 | U00012 | Mycobacterium leprae cosmid B1308. | Mycobacterium leprae | 37,660 | 30-Jan.-96 |
| rxa02351 | 1039 | GB_HTG2:HS225E12 | 126464 | AL031772 | Homo sapiens chromosome 6 clone RP1-225E12 map q24, *** SEQUENCING IN PROGRESS ***, in unordered pieces. | Homo sapiens | 35,973 | 03-DEC.-1999 |
| | | GB_HTG2:HS225E12 | 126464 | AL031772 | Homo sapiens chromosome 6 clone RP1-225E12 map q24, *** SEQUENCING IN PROGRESS ***, in unordered pieces. | Homo sapiens | 35,973 | 03-DEC.-1999 |
| | | GB_HTG2:HS225E12 | 126464 | AL031772 | Homo sapiens chromosome 6 clone RP1-225E12 map q24, *** SEQUENCING IN PROGRESS ***, in unordered pieces. | Homo sapiens | 36,992 | 03-DEC.-1999 |
| rxa02410 | 789 | GB_BA1:AB020624 | 1605 | AB020624 | Corynebacterium glutamicum murI gene for D-glutamate racemase, complete cds. | Corynebacterium glutamicum | 99,227 | 24-Jul.-99 |
| | | GB_EST4:H51527 | 294 | H51527 | yo33b09.s1 Soares adult brain N2b4HB55Y Homo sapiens cDNA clone IMAGE:179705 3', mRNA sequence. | Homo sapiens | 40,411 | 18-Sep.-95 |
| | | GB_GSS1:CNS003CM | 1101 | AL064136 | Drosophila melanogaster genome survey sequence T7 end of BAC # BACR08C19 of RPCI-98 library from Drosophila melanogaster (fruit fly), genomic survey sequence. | Drosophila melanogaster | 37,674 | 3-Jun.-99 |
| rxa02477 | 744 | GB_HTG4:AC010054 | 130191 | AC010054 | Drosophila melanogaster chromosome 3L/74E2 clone RPCI98-15E10, *** SEQUENCING IN PROGRESS ***, 70 unordered pieces. | Drosophila melanogaster | 37,466 | 16-OCT-1999 |
| | | GB_HTG4:AC010054 | 130191 | AC010054 | Drosophila melanogaster chromosome 3L/74E2 clone RPCI98-15E10, *** SEQUENCING IN PROGRESS ***, 70 unordered pieces. | Drosophila melanogaster | 37,466 | 16-OCT-1999 |
| | | GB_HTG4:AC009375 | 137069 | AC009375 | Drosophila melanogaster chromosome 3L/75A1 clone RPCI98-44L18, *** SEQUENCING IN PROGRESS ***, 59 unordered pieces. | Drosophila melanogaster | 39,118 | 16-OCT-1999 |
| rxa02513 | 832 | GB_BA1:MTER260 | 373 | X92572 | M.terrae gene for 32 kDa protein (partial). | Mycobacterium terrae | 42,895 | 15-Jan.-98 |
| | | GB_PL1:AB019229 | 84294 | AB019229 | Arabidopsis thaliana genomic DNA, chromosome 3, P1 clone: MDC16, complete sequence. | Arabidopsis thaliana | 36,084 | 20-Nov.-99 |
| | | GB_PL1:AB019229 | 84294 | AB019229 | Arabidopsis thaliana genomic DNA, chromosome 3, P1 clone: MDC16, complete sequence. | Arabidopsis thaliana | 35,244 | 20-Nov.-99 |
| rxa02531 | 834 | GB_BA1:CGLATTB | 271 | X89850 | C.glutamicum DNA for attB region. | Corynebacterium glutamicum | 40,590 | 8-Aug.-96 |
| | | GB_EST11:AA239557 | 423 | AA239557 | mv25f04.r1 GuayWoodford Beier mouse kidney day 0 Mus musculus cDNA clone IMAGE:656095 5' similar to gb:X52634 Murine tlm oncogene for tlm protein (MOUSE), mRNA sequence. | Mus musculus | 38,760 | 12-MAR.-1997 |
| | | GB_BA1:RSPYPPCL | 6500 | AJ002398 | Rhodobacter sphaeroides pyp and pcl genes, and orfA, orfB, orfC, orfD, orfE, orfF. | Rhodobacter sphaeroides | 37,091 | 17-DEC.-1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02548 | 314 | GB_BA2:AF127374 | 63734 | AF127374 | *Streptomyces lavendulae* LinA homolog, cytochrome P450 hydroxylase ORF4, cytochrome P450 hydroxylase ORF3, MitT (mitT), MitS (mitS), MitR (mitR), MitQ (mitQ), MitP (mitP), MitO (mitO), MitN (mitN), MitM (mitM), MitL (mitL), MitK (mitK), MitJ (mitJ), MitI (mitI), MitH (mitH), MitG (mitG), MitF (mitF), MitE (mitE), MitD (mitD), MitC (mitC), MitB (mitB), MitA (mitA), MmcA (mmcA), MmcB (mmcB), MmcC (mmcC), MmcD (mmcD), MmcE (mmcE), MmcF (mmcF), MmcG (mmcG), MmcH (mmcH), MmcI (mmcI), MmcJ (mmcJ), MmcK (mmcK), MmcL (mmcL), MmcM (mmcM), MmcN (mmcN), MmcO (mmcO), Mrd (mrd), MmcP (mmcP), MmcQ (mmcQ), MmcR (mmcR), MmcS (mmcS), MmcT (mmcT), MmcU (mmcU), MmcV (mmcV), Mct (mct), MmcW (mmcW), MmcX (mmcX), and MmcY (mmcY) genes, complete cds; and unknown genes. | *Streptomyces lavendulae* | 66,242 | 27-MAY-1999 |
| | | GB_BA2:AF127374 | 63734 | AF127374 | *Streptomyces lavendulae* LinA homolog, cytochrome P450 hydroxylase ORF4, cytochrome P450 hydroxylase ORF3, MitT (mitT), MitS (mitS), MitR (mitR), MitQ (mitQ), MitP (mitP), MitO (mitO), MitN (mitN), MitM (mitM), MitL (mitL), Mitk (mitK), MitJ (mitJ), MitI (mitI), MitH (mitH), MitG (mitG), MitF (mitF), MitE (mitE), MitD (mitD), MitC (mitC), MitB (mitB), MiA (mitA), MmcA (mmcA), MmcB (mmcB), MmcC (mmcC), MmcD (mmcD), MmcE (mmcE), MmcF (mmcF), MmcG (mmcG), MmcH (mmcH), MmcI (mmcI), MmcJ (mmcJ), MmcK (mmcK), MmcL (mmcL), MmcM (mmcM), MmcN (mmcN), MmcO (mmcO), Mrd (mrd), MmcP (mmcP), MmcQ (mmcQ), MmcR (mmcR), MmcS (mmcS), MmcT (mmcT), MmcU (mmcU), MmcV (mmcV), Mct (mct), MmcW (mmcW), MmcX (mmcX), and MmcY (mmcY) genes, complete cds; and unknown genes. | *Streptomyces lavendulae* | 38,411 | 27-MAY-1999 |
| rxa02558 | 1098 | GB_GSS4:AQ741886 | 742 | AQ741886 | HS_5569_B2_B02_SP6 RPCI-11 Human Male BAC Library *Homo sapiens* genomic clone Plate=1145 Col=4 Row=D, genomic survey sequence. | *Homo sapiens* | 38,907 | 16-Jul-99 |
| | | GB_EST18:AA567307 | 741 | AA567307 | HL01004.5prime HL *Drosophila melanogaster* head BlueScript *Drosophila melanogaster* cDNA clone HL01004 5prime, mRNA sequence. | *Drosophila melanogaster* | 38,736 | 28-Nov.-98 |
| | | GB_EST27:AI402394 | 630 | AI402394 | GH21610.5prime GH *Drosophila melanogaster* head pOT2 *Drosophila melanogaster* cDNA clone GH21610 5prime, mRNA sequence. | *Drosophila melanogaster* | 41,308 | 8-Feb-99 |
| | | GB_GSS10:AQ237646 | 715 | AQ237646 | RPCI11-6119.TJB RPCI-11 *Homo sapiens* genomic clone RPCI-11-6119, genomic survey sequence. | *Homo sapiens* | 44,340 | 21-Apr-99 |
| rxa02565 | 1389 | GB_EST32:AI726448 | 562 | AI726448 | BNLGHi5854 Six-day Cotton fiber *Gossypium hirsutum* cDNA 5' similar to (U53418) UDP-glucose dehydrogenase [Glycine max], mRNA sequence. | *Gossypium hirsutum* | 37,003 | 11-Jun.-99 |
| | | GB_EST32:AI726198 | 608 | AI726198 | BNLGHi5243 Six-day Cotton fiber *Gossypium hirsutum* cDNA 5' similar to (U53418) UDP-glucose dehydrogenase [Glycine max], mRNA sequence. | *Gossypium hirsutum* | 40,925 | 11-Jun.-99 |
| | | GB_PR4:AC002992 | 154848 | AC002992 | *Homo sapiens* chromosome Y, clone 203M13, complete sequence. | *Homo sapiens* | 38,039 | 13-OCT-1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02574 | 1131 | GB_EST4:H29653 | 415 | H29653 | ym58f01.r1 Soares infant brain 1NIB Homo sapiens cDNA clone IMAGE:52678 5' similar to SP:OXDD_BOVIN P31228 D-ASPARTATE OXIDASE;, mRNA sequence. | Homo sapiens | 39,036 | 17-Jul.-95 |
| | | GB_PR3:HSDJ261K5 | 131974 | AL050350 | Human DNA sequence from clone 261K5 on chromosome 6q21-22.1. Contains the 3' part of the gene for a novel organic cation transporter (BAC ORF RG331P03), the DDO gene for D-aspartate oxidase (EC 1.4.3.1), ESTs, STSs, GSSs and two putative CpG islands, complete sequence. | Homo sapiens | 35,957 | 23-Nov.-99 |
| | | GB_EST2:R20147 | 494 | R20147 | yg18␣o02.r1 Soares infant brain 1NIB Homo sapiens cDNA clone IMAGE:32866 5' similar to SP:OXDD_BOVIN P31228 D-ASPARTATE OXIDASE;, mRNA sequence. | Homo sapiens | 36,437 | 17-Apr.-95 |
| rxa02589 | 888 | GB_HTG1:CEY6E2 | 186306 | Z96799 | Caenorhabditis elegans chromosome V clone Y6E2, ***, SEQUENCING IN PROGRESS ***, in unordered pieces. | Caenorhabditis elegans | 37,979 | 02-OCT-1997 |
| | | GB_HTG1:CEY6E2 | 186306 | Z96799 | Caenorhabditis elegans chromosome V clone Y6E2, *** SEQUENCING IN PROGRESS ***, in unordered pieces. | Caenorhabditis elegans | 37,979 | 02-OCT-1997 |
| rxa02592 | 894 | GB_HTG3:AC011690 | 72277 | AC011690 | Homo sapiens clone 17_E_13, LOW-PASS SEQUENCE SAMPLING. | Homo sapiens | 35,814 | 10-OCT-1999 |
| | | GB_BA1:MSGB983CS | 36788 | L78828 | Mycobacterium leprae cosmid B983 DNA sequence. | Mycobacterium leprae | 53,235 | 15-Jun.-96 |
| | | GB_GSS9:AQ170723 | 487 | AQ170723 | HS_2270_B2_F05_MR CIT Approved Human Genomic Sperm Library D Homo sapiens genomic clone Plate=2270 Col=10 Row=I, genomic survey sequence. | Homo sapiens | 39,666 | 16-OCT-1998 |
| rxa02603 | 1119 | GB_GSS12:AQ349397 | 791 | AQ349397 | RPCI11-118H16.TJ RPCI-11 Homo sapiens genomic clone RPCI-11-118H16, genomic survey sequence. | Homo sapiens | 34,204 | 07-MAY-1999 |
| | | GB_BA1:MTV026 | 23740 | AL022076 | Mycobacterium tuberculosis H37Rv complete genome; segment 157/162. | Mycobacterium tuberculosis | 37,975 | 24-Jun.-99 |
| | | GB_IN2:AC005714 | 177740 | AC005714 | Drosophila melanogaster, chromosome 2R, region 58D4-58E2, BAC clone BACR48M13, complete sequence. | Drosophila melanogaster | 41,226 | 01-MAY-1999 |
| | | GB_EST19:AA775050 | 218 | AA775050 | ac76e10.s1 Stratagene lung (#937210) Homo sapiens cDNA clone IMAGE:868554 3' similar to gb:Y00371_ma1 HEAT SHOCK COGNATE 71 KD PROTEIN (HUMAN);, mRNA sequence. | Homo sapiens | 40,826 | 5-Feb.-98 |
| rxa02630 | 1446 | GB_BA1:MLCL373 | 37304 | AL035500 | Mycobacterium leprae cosmid L373. | Mycobacterium leprae | 49,015 | 27-Aug.-99 |
| | | GB_BA1:MTV044 | 16150 | AL021999 | Mycobacterium tuberculosis H37Rv complete genome; segment 45/162. | Mycobacterium tuberculosis | 49,192 | 17-Jun.-98 |
| rxa02643 | 1167 | GB_BA1:MIU15180 | 38675 | U15180 | Mycobacterium leprae cosmid B1756. | Mycobacterium leprae | 45,621 | 09-MAR-1995 |
| | | GB_EST37:AI950576 | 308 | AI950576 | wx52e08.x1 NCI_CGAP_Lu28 Homo sapiens cDNA clone IMAGE:2547302 3', mRNA sequence. | Homo sapiens | 40,909 | 6-Sep.-99 |
| | | GB_EST37:AI950576 | 308 | AI950576 | wx52e08.x1 NCI_CGAP_Lu28 Homo sapiens cDNA clone IMAGE:2547302 3', mRNA sequence. | Homo sapiens | 40,288 | 6-Sep.-99 |
| rxa02644 | 774 | GB_EST34:AV149547 | 302 | AV149547 | AV149547 Mus musculus C57BL/6J 10–11 day embryo Mus musculus cDNA clone 2810489D03, mRNA sequence. | Mus musculus | 38,627 | 5-Jul.-99 |
| | | GB_EST35:AV156221 | 271 | AV156221 | AV156221 Mus musculus head C57BL/6J 12-day embryo Mus musculus cDNA clone 3000001C24, mRNA sequence. | Mus musculus | 33,990 | 7-Jul.-99 |
| | | GB_EST32:AV054919 | 274 | AV054919 | AV054919 Mus musculus pancreas C57BL/6J adult Mus musculus cDNA clone 1810033C08, mRNA sequence. | Mus musculus | 36,585 | 23-Jun.-99 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02745 | 902 | GB_BA1:MTV007 | 32806 | AL021184 | *Mycobacterium tuberculosis* H37Rv complete genome; segment 64/162. | *Mycobacterium tuberculosis* | 39,298 | 17-Jun.-98 |
| | | GB_BA2:AF027770 | 30683 | AF027770 | *Mycobacterium smegmatis* FxbA (fxbA) gene, partial cds; FxbB (fxbB), FxbC (fxbC), and FxuD (fxtD) genes, complete cds; and unknown genes. | *Mycobacterium smegmatis* 55,125 | 03-DEC.-1998 | |
| | | GB_BA2:SAU43537 | 3938 | U43537 | *Streptomyces argillaceus* mithramycin resistance determinant, ATP-binding protein (mtrA) and membrane protein (mtrB) genes, complete cds. | *Streptomyces argillaceus* | 46,868 | 5-Sep.-96 |
| rxa02746 | 290 | GB_BA1:CAJ10319 | 5368 | AJ010319 | *Corynebacterium glutamicum* amtP, glnB, glnD genes and partial ftsY and srp genes. | *Corynebacterium glutamicum* | 100,000 | 14-MAY-1999 |
| | | GB_BA1:MTCY338 | 29372 | Z74697 | *Mycobacterium tuberculosis* H37Rv complete genome; segment 127/162. | *Mycobacterium tuberculosis* | 39,785 | 17-Jun.-98 |
| | | GB_HTG3:AC008733 | 216140 | AC008733 | *Homo sapiens* chromosome 19 clone CITB-E1_2525115, ***SEQUENCING IN PROGRESS ***, 72 unordered pieces. | *Homo sapiens* | 35,688 | 3-Aug.-99 |
| rxa02820 | 1411 | GB_BA1:BFU64514 | 3837 | U64514 | *Bacillus firmus* dppABC operon, dipeptide transporter protein dppA gene, partial cds, and dipeptide transporter proteins dppB and dppC genes, complete cds. | *Bacillus firmus* | 36,859 | 1-Feb.-97 |
| | | GB_IN1:CET04C10 | 20958 | Z69885 | *Caenorhabditis elegans* cosmid T04C10, complete sequence. | *Caenorhabditis elegans* | 35,934 | 2-Sep.-99 |
| | | GB_EST35:AI823090 | 720 | AI823090 | L30-944T3 Ice plant Lambda Uni-Zap XR expression library, 30 hours NaCl treatment *Mesembryanthemum crystallinum* cDNA clone L30-944 5' similar to 60S ribosomal protein L36 (AC004684)[*Arabidopsis thaliana*], mRNA sequence. | *Mesembryanthemum crystallinum* | 35,770 | 21-Jul.-99 |
| rxa02834 | 518 | GB_BA1:CJY13333 | 3315 | Y13333 | *Campylobacter jejuni* clpB gene. | *Campylobacter jejuni* | 53,400 | 12-Apr.-99 |
| | | GB_BA2:AF065404 | 181654 | AF065404 | *Bacillus anthracis* virulence plasmid PX01, complete sequence. | *Bacillus anthracis* | 45,168 | 20-OCT-1999 |
| | | GB_PL2:AC006601 | 110684 | AC006601 | *Arabidopsis thaliana* chromosome V map near 60.5 cM, complete sequence. | *Arabidopsis thaliana* | 36,680 | 22-Feb.-99 |

SEQUENCE LISTING (442 sequences)

SEQ ID NO: 1 - DNA, 314 bp, Corynebacterium glutamicum
  CDS (1)..(291): RXA02548
ccaccgatctacttctcccacgaccgcgaagttttcgagcgcgacggcatgtggctgaccgcaggcgagtggggtggaccaaagaagggcgaggagatcgtcaccaagactgtccgctaccgcaccgtcggcgatatgtcctgcaccggtgctgtgctctccgaagcccgcaccattgacgatgtgatcgaagagatcgccacctccacccttaccgaacgtggcgcaacccgcgccgatgaccgcctcagcgaatccgcaatggaagaccgcaagaaggaaggctacttctgatgactgctccaaccttgaat

SEQ ID NO: 2 - protein, 97 aa, Corynebacterium glutamicum
PPIYFSHDREVFERDGMWLTAGEWGGPKKGEEIVTKTVRYRTVGDMSCTGAVLSEARTIDDVIEEIATSTLTERGATRADDRLSESAMEDRKKEGYF

SEQ ID NO: 3 - DNA, 980 bp, Corynebacterium glutamicum
  CDS (1)..(957): RXN00249
accggcgtctccacctcccaggttgtagttttgcttgtcgacgcccgccacggcgtcgtcgagcagacccgccgccacctgtccgtatcggctctgctgggcgtacgcacggtgatcctcgcagtcaacaaaattgaccttgttgattacagcgaagaagtcttccgcaacattgaaaaggaattcgttggcctggcatctgcacttgatgtcacagacacccacgttgttccaatctctgcgctcaagggcgacaacgttgcagaaccttccacccacatggattggtacaccggaccaaccgtgctggaaatcctggaaaacgtagaagtttcccacggccgtgcacacgacctgggcttccgcttcccaatccagtacgtcatccgcgagcacgccaccgactaccgtggctacgccggcaccatcaacgctggttccgtctccgtgggcgataccgtgtacctacctgaaggccgcaccacccaggtcacccacatcgattccgctgacggatccctccagaccgcatcagttggagaagccgttgtcctgcgcctagcccaggaaatcgacctcatccgcggcgaactcatcgctggcgaagaccgcccagaatccgttcgctccttcaacgccactgttgttggcttggccgatcgcaccatcaaaccaggtgcagcagtcaaggttcgctacggcaccgagctggtccgcggacgcgtcgcagccatcgaacgagtcctcgacatcgacggcgtcaacgacaacgaagcaccagaaacctacggcctcaacgacatcgcacacgtgcgcatcgacgttgcaggcgaactcgaagttgaagattacgctgcccgcggcgccatcggatccttcctcctcatcgaccaatcctccggcgataccctcgcagctggcttggttggccaccgcctacgcaataactggtcgatctagaccagtgtcttaggcaagac

SEQ ID NO: 4 - protein, 319 aa, Corynebacterium glutamicum
TGVSTSQVVVLLVDARHGVVEQTRRHLSVSALLGVRTVILAVNKIDLVDYSEEVFRNIEKEFVGLASALDVTDTHVVPISALKGDNVAEPSTHMDWYTGPTVLEILENVEVSHGRAHDLGFRFPIQYVIREHATDYRGYAGTINAGSVSVGDTVYLPEGRTTQVTHIDSADGSLQTASVGEAVVLRLAQEIDLIRGELIAGEDRPESVRSFNATVVGLADRTIKPGAAVKVRYGTELVRGRVAAIERVLDIDGVNDNEAPETYGLNDIAHVRIDVAGELEVEDYAARGAIGSFLLIDQSSGDTLAAGLVGHRLRNNWSI

SEQ ID NO: 5 - DNA, 977 bp, Corynebacterium glutamicum
  CDS (1)..(954): FRXA00249
ggtgttttcaccttccaaggtgtagttttgcttgtcgacgcccgccacggcgtcgtcgagcagacccgccgccacctgtccgtatcggctctgctgggcgtacgcacggtgatcctcgcagtcaacaaaattgaccttgttgattacagcgaagaagtcttccgcaacattgaaaaggaattcgttggcctggcatctgcacttgatgtcacagacacccacgttgttccaatctctgcgctcaagggcgacaacgttgcagaaccttccacccacatggattggtacaccggaccaaccgtgctggaaatcctggaaaacgtagaagtttcccacggccgtgcacacgacctgggcttccgcttcccaatccagtacgtcatccgcgagcacgccaccgactaccgtggctacgccggcaccatcaacgctggttccgtctccgtgggcgataccgtgtacctacctgaaggccgcaccacccaggtcacccacatcgattccgctgacggatccctccagaccgcatcagttggagaagccgttgtcctgcgcctagcccaggaaatcgacctcatccgcggcgaactcatcgctggcgaagaccgcccagaatccgttcgctccttcaacgccactgttgttggcttggccgatcgcaccatcaaaccaggtgcagcagtcaaggttcgctacggcaccgagctggtccgcggacgcgtcgcagccatcgaacgagtcctcgacatcgacggcgtcaacgacaacgaagcaccagaaacctacggcctcaacgacatcgcacacgtgcgcatcgacgttgcaggcgaactcgaagttgaagattacgctgcccgcggcgccatcggatccttcctcctcatcgaccaatcctccggcgataccctcgcagctggcttggttggccaccgcctacgcaataactggtcgatctagaccagtgtcttaggcaagac

SEQ ID NO: 6 - protein, 318 aa, Corynebacterium glutamicum
GVFTFQGVVLLVDARHGVVEQTRRHLSVSALLGVRTVILAVNKIDLVDYSEEVFRNIEKEFVGLASALDVTDTHVVPISALKGDNVAEPSTHMDWYTGPTVLEILENVEVSHGRAHDLGFRFPIQYVIREHATDYRGYAGTINAGSVSVGDTVYLPEGRTTQVTHIDSADGSLQTASVGEAVVLRLAQEIDLIRGELIAGEDRPESVRSFNATVVGLADRTIKPGAAVKVRYGTELVRGRVAAIERVLDIDGVNDNEAPETYGLNDIAHVRIDVAGELEVEDYAARGAIGSFLLIDQSSGDTLAAGLVGHRLRNNWSI

SEQ ID NO: 7 - DNA, 954 bp, Corynebacterium glutamicum
  CDS (101)..(931): RXA01073
taaccgactccagcactaaactccaaacccttggcccgcaccgccaaagtttagcgcgccccaagacaccaccgcgccatgtttgcctaggattaggtacatgacaaacactcaaaccgagatcattaatgaactaaaggtgagcccagcaatcgacgtggccaaggaagttgaattccgtgtgcagttcctcgtcgattacctgcgggcttcccatacaaaaggctttgttcttggtatttcaggtggccaggattccactcttgcgggacgactcacgcagctggcagtagagcgcattcgtgcggaagaaaacagcacggattatgtcttctacgcagttcgcctcccctacgcgatccaggcagatgaggacgatgcgcaagttgcattggaattcatcgcacctgacaagagcgtgaccgtcaacgttaaagacgcaacggacgccaccgaagcaactgttgcagctgctttggaacttcctgagctgaccgacttcaatcggggcaatattaaagctcgccaacgcatggttgcccagtacgcaatcgcaggccagttgggcttgctggttattggcactgatcacgcggctgaaaacgtcacggggttcttcaccaaattcggtgatggcgcagctgacctgcttcctttggcaggtttgagcaagcgtcaaggagctgccattctggagcacctgggtgcaccttcaagcacgtggaccaaggttcctaccgctgatttggaagaggatcgcccagcgttgccagatgaggaagcacttggtgtgtcgtatgcggacatcgataattacctggaaaacaagcccgatgtcagtgaaaaagcccagcagcgcattgagcacctgtggaaggtgggccagcacaagcgccacctccctgctaccccgcaggaaaattggtggcgttaatccaacagtttgagtgtcgc

SEQ ID NO: 8 - protein, 277 aa, Corynebacterium glutamicum
MTNTQTEIINELKVSPAIDVAKEVEFRVQFLVDYLRASHTKGFVLGISGGQDSTLAGRLTQLAVERIRAEENSTDYVFYAVRLPYAIQADEDDAQVALEFIAPDKSVTVNVKDATDATEATVAAALELPELTDFNRGNIKARQRMVAQYAIAGQLGLLVIGTDHAAENVTGFFTKFGDGAADLLPLAGLSKRQGAAILEHLGAPSSTWTKVPTADLEEDRPALPDEEALGVSYADIDNYLENKPDVSEKAQQRIEHLWKVGQHKRHLPATPQENWWR

SEQ ID NO: 9 - DNA, 609 bp, Corynebacterium glutamicum
  CDS (101)..(586): RXN02913
tccctgacatccaggttgaagcaacgtttgatgacggcaccaagctcgtcaccgtgcacaatcccatccgataacccttgatgtttttaggagttttgtcatgatcccaggcgagtacatcctgtccagcgaatcactcaccggaaatgttgggcgcgaggccaaaaccatcgaaatcatcaacaccggtgataggcctgtgcagattggttcgcatttccacttcgctgaagtaaaccccagcatcagctttgatcgcagtgaaggttacggcttccgccttgatattccatccggcaccgcggtgcgcctcgagccaggcgatgcccgcaccgtcaaccttgttgccattggcggtgaccgcattgttgcaggtttccgagatctcgtcgatgggccgttggaggacctcaaagtcaacgtgtgggagggacgcgaagacggttggcgtcgttcctcagctgctggtgatgctccacaagaattgccacaggtcgaagctgctgaacgtggccggaaactagatgacgccactgatgtggacacaaatgtgggcacagaagaaggctttgaagaaggtcgaaattaaatgagttttgagatttcccg

SEQ ID NO: 10 - protein, 162 aa, Corynebacterium glutamicum
MIPGEYILSSESLTGNVGREAKTIEIINTGDRPVQIGSHFHFAEVNPSISFDRSEGYGFRLDIPSGTAVRLEPGDARTVNLVAIGGDRIVAGFRDLVDGPLEDLKVNVWEGREDGWRRSSAAGDAPQELPQVEAAERGRKLDDATDVDTNVGTEEGFEEGRN

SEQ ID NO: 11 - DNA, 220 bp, Corynebacterium glutamicum
  CDS (101)..(220): FRXA02264
tccctgacatccaggttgaagcaacgtttgatgacggcaccaagctcgtcaccgtgcacaatcccatccgataacccttgatgtttttaggagttttgtcatgatcccaggcgagtacatcctgtccagcgaatcactcaccggaaatgttgggcgcgaggccaaaaccatcgaaatcatcaacaccggtgataggcctgtgcagattggttcgcatttc

SEQ ID NO: 12 - protein, 40 aa, Corynebacterium glutamicum
MIPGEYILSSESLTGNVGREAKTIEIINTGDRPVQIGSHF

SEQ ID NO: 13 - DNA, 1833 bp, Corynebacterium glutamicum
  CDS (101)..(1810): RXN02274
acaggtcgaagctgctgaacgtggccggaaactagatgacgccactgatgtggacacaaatgtgggcacagaagaaggctttgaagaaggtcgaaattaaatgagttttgagatttcccgcaagcagtacaccgacctttatggtccaaccgttggcgattcagtacgtcttgctgatactgagctttttctctgtgtggaaaaagattacgcagcaatcggcgaagaagtagcattcggcggtggcaaggtcattcgtgatggcatgggccaaaatggcaccttggttcgcgatgtagatattcccgataccgtcatcaccaacgtcatcgtccttgactatacgggtgtgtacaaagctgacgttgcgcttcgagatggcaaaatcttccgaatcggaaaggccggaaacccgaatgtcatggaaaacgtcgacatcgtcatcggcgttgccaccgacatcattgctggtgaaggcaaaatccttaccgcaggtggcatcgacacgcacgtgcacttcttgggcacagaccaggtcaacactgcattagcatcaggtatcaccacgatgatcggtggaggcaccggcccaagccaggcgtcgatggctacaactgtcacgccaggtcagtggaatacctacaacatgcttagtgcttttgaaggcatgcccatgaactttggcattttgggtaaaggccatggttcttccaaatctccgctggctgagcaggttcgtgcgggtgcaatcggtctgaaaattcacgaggactggggtgccacaccatcgtcgatcaacactgccctagaagtagccgatgacatggacatccaggtggcactccactccgataccttgaatgaggccggttttgtggaagacaccattgaagccattgcgggccgagtcatccataccttccacaccgaaggtgctggtggtggacacgctcctgacctaatccgagtggctgctctgccaaacgtgttgcctgcatccaccaacccaacgctcccatacacccgaaacactgttgaagagcacctggacatggtgatggttgcccaccacctcaacccagatattccagaagacgtggcttttgcggattcccgaattcgtgccgaaacgattgcagccgaagatgtgcttcacgatatgggtatcttctctatcacctcttcggattcccaggcgatgggccgagtaggagagaccatcacgcgcacgtggcaggtcgccgaccatatgaaacgcacccgtggatcactaacgggagatgctccatacaacgacaacaaccgcttgcgtcgattcatcgcaaaatacaccatcaaccctgcgattgcgcacggtgtggattatgttgttcgttcagtggaggaaggcaagttcgctgacctcgtgctgtgggatccaaagttctttggtgtgaaacctgatctggtgatcaagggtgggttgatggtcaattccctcatgggtgattccaacggttccattccaactccgcagccccgcaccctgcgcaatacttggggtgcgtttggccaggcagtttccagaagctccattacattcctatcccaggacgctatcgatgcaaatgttcctgatctgctgaatctgaggaagcagatccggggcgttcgaggtgtaaggaatctgaccaaacgagacatgaaactcaatgcagaaatgcctgatattcgtgtcgatccagagacctaccaggtgtttgtcaacggtgagttgatcaccagcaagccagcagagacagtgccaatggcacgtcgctacttcttgttctaatccgccaacaaggaaggaag

SEQ ID NO: 14 - protein, 570 aa, Corynebacterium glutamicum
MSFEISRKQYTDLYGPTVGDSVRLADTELFLCVEKDYAAIGEEVAFGGGKVIRDGMGQNGTLVRDVDIPDTVITNVIVLDYTGVYKADVALRDGKIFRIGKAGNPNVMENVDIVIGVATDIIAGEGKILTAGGIDTHVHFLGTDQVNTALASGITTMIGGGTGPSQASMATTVTPGQWNTYNMLSAFEGMPMNFGILGKGHGSSKSPLAEQVRAGAIGLKIHEDWGATPSSINTALEVADDMDIQVALHSDTLNEAGFVEDTIEAIAGRVIHTFHTEGAGGGHAPDLIRVAALPNVLPASTNPTLPYTRNTVEEHLDMVMVAHHLNPDIPEDVAFADSRIRAETIAAEDVLHDMGIFSITSSDSQAMGRVGETITRTWQVADHMKRTRGSLTGDAPYNDNNRLRRFIAKYTINPAIAHGVDYVVRSVEEGKFADLVLWDPKFFGVKPDLVIKGGLMVNSLMGDSNGSIPTPQPRTLRNTWGAFGQAVSRSSITFLSQDAIDANVPDLLNLRKQIRGVRGVRNLTKRDMKLNAEMPDIRVDPETYQVFVNGELITSKPAETVPMARRYFLF

SEQ ID NO: 15 - DNA, 1625 bp, Corynebacterium glutamicum
  CDS (1)..(1602): FRXA02274
tacgcagcaatcggcgaagaagtagcattcggcggtggcaaggtcattcgtgatggcatgggccaaaatggcaccttggttcgcgatgtagatattcccgataccgtcatcaccaacgtcatcgtccttgactatacgggtgtgtacaaagctgacgttgcgcttcgagatggcaaaatcttccgaatcggaaaggccggaaacccgaatgtcatggaaaacgtcgacatcgtcatcggcgttgccaccgacatcattgctggtgaaggcaaaatccttaccgcaggtggcatcgacacgcacgtgcacttcttgggcacagaccaggtcaacactgcattagcatcaggtatcaccacgatgatcggtggaggcaccggcccaagccaggcgtcgatggctacaactgtcacgccaggtcagtggaatacctacaacatgcttagtgcttttgaaggcatgcccatgaactttggcattttgggtaaaggccatggttcttccaaatctccgctggctgagcaggttcgtgcgggtgcaatcggtctgaaaattcacgaggactggggtgccacaccatcgtcgatcaacactgccctagaagtagccgatgacatggacatccaggtggcactccactccgataccttgaatgaggccggttttgtggaagacaccattgaagccattgcgggccgagtcatccataccttccacaccgaaggtgctggtggtggacacgctcctgacctaatccgagtggctgctctgccaaacgtgttgcctgcatccaccaacccaacgctcccatacacccgaaacactgttgaagagcacctggacatggtgatggttgcccaccacctcaacccagatattccagaagacgtggcttttgcggattcccgaattcgtgccgaaacgattgcagccgaagatgtgcttcacgatatgggtatcttctctatcacctcttcggattcccaggcgatgggccgagtaggagagaccatcacgcgcacgtggcaggtcgccgaccatatgaaacgcacccgtggatcactaacgggagatgctccatacaacgacaacaaccgcttgcgtcgattcatcgcaaaatacaccatcaaccctgcgattgcgcacggtgtggattatgttgttcgttcagtggaggaaggcaagttcgctgacctcgtgctgtgggatccaaagttctttggtgtgaaacctgatctggtgatcaagggtgggttgatggtcaattccctcatgggtgattccaacggttccattccaactccgcagccccgcaccctgcgcaatacttggggtgcgtttggccaggcagtttccagaagctccattacattcctatcccaggacgctatcgatgcaaatgttcctgatctgctgaatctgaggaagcagatccggggcgttcgaggtgtaaggaatctgaccaaacgagacatgaaactcaatgcagaaatgcctgatattcgtgtcgatccagagacctaccaggtgtttgtcaacggtgagttgatcaccagcaagccagcagagacagtgccaatggcacgtcgctacttcttgttctaatccgccaacaaggaaggaag

SEQ ID NO: 16 - protein, 534 aa, Corynebacterium glutamicum
YAAIGEEVAFGGGKVIRDGMGQNGTLVRDVDIPDTVITNVIVLDYTGVYKADVALRDGKIFRIGKAGNPNVMENVDIVIGVATDIIAGEGKILTAGGIDTHVHFLGTDQVNTALASGITTMIGGGTGPSQASMATTVTPGQWNTYNMLSAFEGMPMNFGILGKGHGSSKSPLAEQVRAGAIGLKIHEDWGATPSSINTALEVADDMDIQVALHSDTLNEAGFVEDTIEAIAGRVIHTFHTEGAGGGHAPDLIRVAALPNVLPASTNPTLPYTRNTVEEHLDMVMVAHHLNPDIPEDVAFADSRIRAETIAAEDVLHDMGIFSITSSDSQAMGRVGETITRTWQVADHMKRTRGSLTGDAPYNDNNRLRRFIAKYTINPAIAHGVDYVVRSVEEGKFADLVLWDPKFFGVKPDLVIKGGLMVNSLMGDSNGSIPTPQPRTLRNTWGAFGQAVSRSSITFLSQDAIDANVPDLLNLRKQIRGVRGVRNLTKRDMKLNAEMPDIRVDPETYQVFVNGELITSKPAETVPMARRYFLF

SEQ ID NO: 17 - DNA, 423 bp, Corynebacterium glutamicum
  CDS (101)..(400): RXA02265
tcaaaggaaagcagtatattgtcggttttttagaggctctcccaaatattgcgttgggggagctaaactaatttctgttacctgacagaaaggggcaaaattgcatatcactcctcgtgaacaagaaaaactgatgatcgtggtggcggctgaccttgcacgtcgccgtaaagatcgcggcctaaaacttaaccacccagaggccgtcgccctcatcacgtatgaactgattgaaggcgcccgtgacggacgcacagtcgcagaccttatgagctggggaagcaccattttgactagggatgatgtcttagaaggcatcccagagatgatccctgacatccaggttgaagcaacgtttgatgacggcaccaagctcgtcaccgtgcacaatcccatccgataacccttgatgtttttaggagt

SEQ ID NO: 18 - protein, 100 aa, Corynebacterium glutamicum
LHITPREQEKLMIVVAADLARRRKDRGLKLNHPEAVALITYELIEGARDGRTVADLMSWGSTILTRDDVLEGIPEMIPDIQVEATFDDGTKLVTVHNPIR

SEQ ID NO: 19 - DNA, 972 bp, Corynebacterium glutamicum
  CDS (101)..(949): RXA02278
accattctgcctgactaatctgcgcaccgatgatggtttggataaggtcttggaatggatccgccatgaggtgatgatgcaggacttgcaggaagcctaaatgacacaaacccaaccagtgggaaccctgcgactgaccatcgatgatcaaggaccccaaggtcaaagccgtgcggtggagcaatttcaccagggtgcgcttcgagtcatccggccacactacttggatgattccggacaggtttgctacaccatcattgccattggtggcggatacctgggcggcgatgtgtatgagcagcaattcacgatcaaagacaacgcaaaagctttgatcaccacgcaatcggccaccaagatttatcgcacaccgcaaggaccagccacgcagcacaccgaaatcaacgtcggtgaaaatgctgtgctggaatacttggcggatcaaaccatcgcgtaccgggaggccacctatcatcaattcaccaaggtggcgctgcacccgagcgcaacgtttgtgatgagcgaacaaatcaccccaggctggcaccccgacggcaaacactttgcttacgatgaaatgcgtctacacaccgaaatcacggactccaccacagggcgactcgtgctcttggataatttactgctccggccggactcccgagagggaagttttgggtggacggaacagtacacacattcagggcagatgattgtgatgggggaaggcgtcgataagcagcttgttgctgagctgaatgagcaacttgccgcgcaccctgatgtgtacggcgccgtcaatttcttaagcgcgccgggcacgttactgcgcggatttattgcgcgcacgctgagcaaccgcactgaggagttgattaacctgcacgaacacattgcgtcgctgttgcgcgggcggtggcgcgggcaggaaccggtgaatttgcggaagtactagacggcgtcgagaaatcgaag

SEQ ID NO: 20 - protein, 283 aa, Corynebacterium glutamicum
MTQTQPVGTLRLTIDDQGPQGQSRAVEQFHQGALRVIRPHYLDDSGQVCYTIIAIGGGYLGGDVYEQQFTIKDNAKALITTQSATKIYRTPQGPATQHTEINVGENAVLEYLADQTIAYREATYHQFTKVALHPSATFVMSEQITPGWHPDGKHFAYDEMRLHTEITDSTTGRLVLLDNLLLRPDSREGSFGWTEQYTHSGQMIVMGEGVDKQLVAELNEQLAAHPDVYGAVNFLSAPGTLLRGFIARTLSNRTEELINLHEHIASLLRGRWRGQEPVNLRKY

SEQ ID NO: 21 - DNA, 594 bp, Corynebacterium glutamicum
  CDS (101)..(571): RXA02275
gtttgtcaacggtgagttgatcaccagcaagccagcagagacagtgccaatggcacgtcgctacttcttgttctaatccgccaacaaggaaggaagatccatgattatcactgcgatcgacaccaacatctacgatgaaccggagtttgttgaaggacgcgatgtcatcggtgtgcgctttgaagatttagttttggataagcgcattcaacgggttgcactccccggaggagaagaactggggttgcggttaaaccacgggcatccgattctgcgtgaaggtgatgtgttgaaagctgatgataagacggtatttgtggtggagattatccccacggatgttttagttatcacgccaagcgatattcaccagatgggatttgtggcgcactccctgggaaacaggcacctgccagcacagttttccaagccaggtgaattgacagagaaggcagccatgatcgtgcaatacgatcacacggtggtcagcttcttggatgagcacggcatcgagtatcagcgcaccgaacttgttccgccaattcctttcaggcatagcgggcacacacattgatggatcttgacgctgatttt

SEQ ID NO: 22 - protein, 157 aa, Corynebacterium glutamicum
MIITAIDTNIYDEPEFVEGRDVIGVRFEDLVLDKRIQRVALPGGEELGLRLNHGHPILREGDVLKADDKTVFVVEIIPTDVLVITPSDIHQMGFVAHSLGNRHLPAQFSKPGELTEKAAMIVQYDHTVVSFLDEHGIEYQRTELVPPIPFRHSGHTH

SEQ ID NO: 23 - DNA, 801 bp, Corynebacterium glutamicum
  CDS (101)..(778): RXA02276
atcacacggtggtcagcttcttggatgagcacggcatcgagtatcagcgcaccgaacttgttccgccaattcctttcaggcatagcgggcacacacattgatggatcttgacgctgattttctgctgttgcatttatcggattcagcacttccaacgggagcgtttgcgcactcatttggatttgaaacttatatggatgcagagcgaatcaccaatgcagaggagttccaagactggctgaaagtcctgcttaaggtgcaattgaccagctctgatgctttggcaatgaggatgttttacgccaccccgacggtgtctgagctgaaacggctggatgagcgcctttttgctggaactccggcgagagaaattcgggaagctaatgctcgaatgggtacgcgcatggcagagatcgtggctgaaacctactccgtgcccctgattgttgagtatctcgaattgattcaacatcgagagctatcagggcacccggctttggctttggctcttgccacccacagcgcggggattgatgtggatcgagcaatccacgctcacctcacggcaacggtgagttcgctgatccaaaatgcggttcgtggcatcccactggggcaaatggcaggtcagcgggtgatgttcgccatgcgtgagcatatcggtgcggccgtgaaacgtagcgcgaacttggatgagattgatttctgttcgggtgatccaggcttggatatttcacaaatggttcatgaaacccaacgcgcacgactatttatgagttaagaaggagaaaagaaacatgg

SEQ ID NO: 24 - protein, 226 aa, Corynebacterium glutamicum
MDLDADFLLLHLSDSALPTGAFAHSFGFETYMDAERITNAEEFQDWLKVLLKVQLTSSDALAMRMFYATPTVSELKRLDERLFAGTPAREIREANARMGTRMAEIVAETYSVPLIVEYLELIQHRELSGHPALALALATHSAGIDVDRAIHAHLTATVSSLIQNAVRGIPLGQMAGQRVMFAMREHIGAAVKRSANLDEIDFCSGDPGLDISQMVHETQRARLFMS

SEQ ID NO: 25 - DNA, 738 bp, Corynebacterium glutamicum
  CDS (101)..(715): RXA02277
attgatttctgttcgggtgatccaggcttggatatttcacaaatggttcatgaaacccaacgcgcacgactatttatgagttaagaaggagaaaagaaacatgggtccaatcagaatcggcgtaggcgggccggtcggcgccggaaaaacgcagctggtagagcggattacgcgagcgcttatcgacgaagtcagcatggctgcaatcactaacgatatctacaccattgaagacgccaagattcttgccgccaatggagtgctgccagaagaacgcattgttggcattgaaactggaggatgcccacacactgcgattcgtgaagacacctccatgaatgatgcagcgatcaaagaccttgtggaacgcttcccagatctggaactcatctttgtggaatctggtggagataatctctctgcaacgttctcgccagagctggtggatttttccatctacatcatcgatgttgcccaaggtgagaagatcccgaggaaagctggccaaggcatgattaagtcggatttgtttatcattaataaaactgaccttgccccatatgttggtgccaacctagatgtcatggtggaagatgccaaagcattccgcaagaacaaaccattctgcctgactaatctgcgcaccgatgatggtttggataaggtcttggaatggatccgccatgaggtgatgatgcaggacttgcaggaagcctaaatgacacaaacccaaccagt

SEQ ID NO: 26 - protein, 205 aa, Corynebacterium glutamicum
MGPIRIGVGGPVGAGKTQLVERITRALIDEVSMAAITNDIYTIEDAKILAANGVLPEERIVGIETGGCPHTAIREDTSMNDAAIKDLVERFPDLELIFVESGGDNLSATFSPELVDFSIYIIDVAQGEKIPRKAGQGMIKSDLFIINKTDLAPYVGANLDVMVEDAKAFRKNKPFCLTNLRTDDGLDKVLEWIRHEVMMQDLQEA

SEQ ID NO: 27 - DNA, 1119 bp, Corynebacterium glutamicum
  CDS (101)..(1096): RXA02603
gcatggtgcttggcgtgcattacccaaccgatgtgctagccggcgcgttgttgggagcagcgaccgcagaggccgtccataagatcgaaagggctacgaagtgagcgaacacgccgctgaacatcaccgcgatacccaaaatttcttaacctccgaaccgcacaccacggcaatcgaagacaacaagaagcgccaaccgccgaaaaaccttgctgacggcatgatcaaggcgctgcgccccaagcagtgggtcaagaacgttcttgtgctagcagcaccacttgctgctggtgcagatgcgatcttcaaccagcgcacgatcatcgacgttgctatcgcattcgtagtgttctgcttcggtgcatcagccatttacttggttaatgatgcccgtgacgtggaagctgaccgcgagcacccaaccaagcgtttccgccccatcgctgcaggagtcctgccagtaggaatggcatacggcatggccgtggcgctcattgcactatccatcggactgtctttcctcgccaccgacggcgtggcacttgcctgcgtgattggcgtgtacattgcgctgcagctgggatactgcttcggttggaagcacatgccagtgatcgatattgcgcttgtctcctccggattcatgctccgcgcaatggcaggtggtgtcgcagcaggcatcgagctatcccagtggttcctgctagtcgctgcgtttggttccctgttcatggcatctggaaagcgctacgcagaaatccttctgcacgagcgcaccggcgctaagatccgcaagtccctggaaagctacacccccacctacctgcgcttcgtttggaccatggcagcaacagcagtggtcatgtcctacgcactgtggggcttcgacctttcccaacactccaccgacgcaggtccgtggtaccaaatctccatggttccattcaccatcgccatcctgcgctacgcagccggcgtagacaccggcgacggcggtgcccctgacgaagtggcactcagcgacaaagttctgcaggtactagccctagcatgggttttctgcatcgtgatggctgtgtacatcatgccgatgttttgaatatttaccaatgaacatgc

SEQ ID NO: 28 - protein, 332 aa, Corynebacterium glutamicum
VSEHAAEHHRDTQNFLTSEPHTTAIEDNKKRQPPKNLADGMIKALRPKQWVKNVLVLAAPLAAGADAIFNQRTIIDVAIAFVVFCFGASAIYLVNDARDVEADREHPTKRFRPIAAGVLPVGMAYGMAVALIALSIGLSFLATDGVALACVIGVYIALQLGYCFGWKHMPVIDIALVSSGFMLRAMAGGVAAGIELSQWFLLVAAFGSLFMASGKRYAEILLHERTGAKIRKSLESYTPTYLRFVWTMAATAVVMSYALWGFDLSQHSTDAGPWYQISMVPFTIAILRYAAGVDTGDGGAPDEVALSDKVLQVLALAWVFCIVMAVYIMPMF

SEQ ID NO: 29 - DNA, 2004 bp, Corynebacterium glutamicum
  CDS (101)..(1981): RXA01385
atcacactttcattcgcagtgtgatctgaactacatttctggttactgtacggaacacgctccgtgaatgagataggaaatcccctcgaaaggaccagacatgcagtttcattatgaaggatacgcaaccggtgacccaatggagatgcgcgcggaaggtagcggaatcaaccgcccggacgatctccccgaggtcatggatgttctcatcgttggtgcaggtccggctggcaccatcgcagcggctcagctttcccgattccccaatgtgaccacccgcctcgtagagagaagcgaccgtcgcctcgaactagccaatgcagatggcgtgcactcccgaaccattgaaactttccaggcatttggtttcgcccacgagatcctcgccgaagctcatgaaatcaccgacatggcgttctggaagccggacccgcaaaaccctcgtgagatcattcgcgacaacagcacccgcgagctgccacagcacatcagtgaatttccgatggcgttgctcacccagacccgcatcatcgaccacttcaaccggttcatgaagaactccccaaccaggatgaagcctgactatggatacgagttcgtggactttgaagtagaagaagacgcagaatatccggtaattgtcaccctccgccgcaccagtggcgagcaaactggcgaattggtcaccgtccgaaccaagtacctggtcggtgccgatggtgcacgaagccaagtgcgcaaatcactgggataccgactccaaggtaagcaggctaaccacgcttggggtgtgatggatattcacgcgaacaccgagttccccgacgtgcgcaagaagtgcaccatcaaatctgattcgggtcgcaccatcttgctcatcccacgtgagggtggcttcctcttccgtctctacgttgacctgggcgaagtacctgatgatggcagcaaggctgttcgtgataccccactccaggatgtcatcgacaccgcgaaccagatcatggctccattcaccctcgacgtgaaaaacgttgtgtggaactccatctacgaggtaggccaccgcgtcgcagaccatttcgatgaccgtgtttcagaaaaaacctcgagcgaacacccacgcattttcattgctggcgacgcctgccacacccacagcgctaaggctggccagggcatgaacgtgtccatgcaggacggattcaaccttggctggaagcttggacatgtggccagcggaaatagcccacgcgaactacttcagacctacgctgaagagcgcgaagacattgcctacaagctcatcgagtacgacaagaactggtcaacactcatggcaaagccaagcagcgaaatgggcagtgcccaagaccttgaggatttctaccgcgcgaactctgagttcaatgccggctacatgacccactatcctccttcttccatcacaatggatggcagcaaccaagatctggcaaagggctacccaattggccgacgcttcaagtcagcgatggttggtcgagtctgcgacttcaccgaaacacacctcggtcaccaagcaacagccgacggacgcatgcgcgcatacgtcttcgcaggatccgatgcacttaacggcgagggttctgagctagaccgctgggcagaatgggcagaggcgaaccttgaccccacgcttgtcgacgccaaggtgatttaccaaagcccttataccgagctcgacacccgccaggttccatccgtgttcaaacctgcagtcgggatcttcgaactgaccaatgtggaaaactccttcggtatcaccacggactccgacatctttgatagtcgcgagatctcccgcgatggtgtcgtggtggtagtccgaccagaccaatacgtttccggaatcttcccactcactgatacccaagggcttggcgaattcctcaccggatacttccccaaaatgaaaggcgcacatcagctaatcaacgcgaactaaggcacagctgttaaaacagt

SEQ ID NO: 30 - protein, 627 aa, Corynebacterium glutamicum
MQFHYEGYATGDPMEMRAEGSGINRPDDLPEVMDVLIVGAGPAGTIAAAQLSRFPNVTTRLVERSDRRLELANADGVHSRTIETFQAFGFAHEILAEAHEITDMAFWKPDPQNPREIIRDNSTRELPQHISEFPMALLTQTRIIDHFNRFMKNSPTRMKPDYGYEFVDFEVEEDAEYPVIVTLRRTSGEQTGELVTVRTKYLVGADGARSQVRKSLGYRLQGKQANHAWGVMDIHANTEFPDVRKKCTIKSDSGRTILLIPREGGFLFRLYVDLGEVPDDGSKAVRDTPLQDVIDTANQIMAPFTLDVKNVVWNSIYEVGHRVADHFDDRVSEKTSSEHPRIFIAGDACHTHSAKAGQGMNVSMQDGFNLGWKLGHVASGNSPRELLQTYAEEREDIAYKLIEYDKNWSTLMAKPSSEMGSAQDLEDFYRANSEFNAGYMTHYPPSSITMDGSNQDLAKGYPIGRRFKSAMVGRVCDFTETHLGHQATADGRMRAYVFAGSDALNGEGSELDRWAEWAEANLDPTLVDAKVIYQSPYTELDTRQVPSVFKPAVGIFELTNVENSFGITTDSDIFDSREISRDGVVVVVRPDQYVSGIFPLTDTQGLGEFLTGYFPKMKGAHQLINAN

SEQ ID NO: 31 - DNA, 915 bp, Corynebacterium glutamicum
  CDS (101)..(892): RXN00675
gtggaagtactcacctcaaggtggccggaaccgcatgcattgtgcggtgccggccacctttggttttaacagtttaatttgaagaaagagacgtggaagcatgggtttccgttccaagaagaaggttattgcggcaaagaccgccgctgagctggacgcgatgcaggcggcgggtgagatcgtcggcaaggctttgcaggctgtgcgcgctgaggctaaagctggcatgagcacgtgggatctggatcagatcgcggagcaggttatccgcgatgctggcgccgttcctacattcctgggttaccagggttttccggcatcagtgtgcgcttcggtcaatgaggtgattgttcacggcattccatccaaggagaccatcttggaggaaggcgatctggtgtccatcgactgcggcgcaacctttgatggttgggtcggcgattccgcgtggagcttcggcatcggcgagctggacgaggacgtccagggtctcaacttggctaccgagtgggtcctcatggaaggcatgaaggccatggttccaggcaaccgtttgaccgatgtctcccacgctctcgaggtcgcaacccgcaaggctgagtccaagttcggcgtcgcgctcggcatcgtcgatggctacggcggacacggcattggccgccacatgcacgaggagccatacttggctaatgagggcaaggccggcaagggccctgtgattcaggagggctccgtgctcgccattgagcctatgctcaccctcggcaccgaagattccgcagtgctggaagatgattggactgtcgtgactctcgacggttcatgggcatcacactgggagcacaccgttgcagccaccaagggcggcccgcgcatcctcacgccgcgttattaaaatgatgcttttcgacgcat

SEQ ID NO: 32 - protein, 264 aa, Corynebacterium glutamicum
MGFRSKKKVIAAKTAAELDAMQAAGEIVGKALQAVRAEAKAGMSTWDLDQIAEQVIRDAGAVPTFLGYQGFPASVCASVNEVIVHGIPSKETILEEGDLVSIDCGATFDGWVGDSAWSFGIGELDEDVQGLNLATEWVLMEGMKAMVPGNRLTDVSHALEVATRKAESKFGVALGIVDGYGGHGIGRHMHEEPYLANEGKAGKGPVIQEGSVLAIEPMLTLGTEDSAVLEDDWTVVTLDGSWASHWEHTVAATKGGPRILTPRY

SEQ ID NO: 33 - DNA, 506 bp, Corynebacterium glutamicum
  CDS (1)..(483): FRXA00675
tgcggcgcaacctttgatggttgggtcggcgattccgcgtggagcttcggcatcggcgagctggacgaggacgtccagggtctcaacttggctaccgagtgggtcctcatggaaggcatgaaggccatggttccaggcaaccgtttgaccgatgtctcccacgctctcgaggtcgcaacccgcaaggctgagtccaagttcggcgtcgcgctcggcatcgtcgatggctacggcggacacggcattggccgccacatgcacgaggagccatacttggctaatgagggcaaggccggcaagggccctgtgattcaggagggctccgtgctcgccattgagcctatgctcaccctcggcaccgaagattccgcagtgctggaagatgattggactgtcgtgactctcgacggttcatgggcatcacactgggagcacaccgttgcagccaccaagggcggcccgcgcatcctcacgccgcgttattaaaatgatgcttttcgacgcat

SEQ ID NO: 34 - protein, 161 aa, Corynebacterium glutamicum
CGATFDGWVGDSAWSFGIGELDEDVQGLNLATEWVLMEGMKAMVPGNRLTDVSHALEVATRKAESKFGVALGIVDGYGGHGIGRHMHEEPYLANEGKAGKGPVIQEGSVLAIEPMLTLGTEDSAVLEDDWTVVTLDGSWASHWEHTVAATKGGPRILTPRY

SEQ ID NO: 35 - DNA, 996 bp, Corynebacterium glutamicum
  CDS (101)..(973): RXA01609
gttgcagtcagtgaagctgaagagcagccagtcggctaaaaaatagcctccatccaacccgctttacctgtcatcgcttcaggcgactagcatggtgaccatgtctaaaatgcgcgcaccacttgtacccggaattcctaccccaatcagggaagtacctgcacatattgaacgtccagaatatgtgtggaaggacgaagtccaagaagcaatcggtgagccttttgtgcaggcccctgaggtcatcgagaagatgcgtgagacatctcgcatcgctgcaaactcactgaaaatcgcgggcgaagccgtcaagccaggcgtgaccactgatgaacttgatcgcattgtgcatgagtacacctgcgatatgggcgcatacccttcagatcttggttaccggggattcaccaagtcctcatgcatttccctcaatgagatcgtgtgccacggtattcctgattccaccgtcattgaagagggcgatattgttaacatcgatgtcaccgcgttcaagcacggcgtccacggcgactgcaatgccaccttcttagcgggtgatgtttctgaagaacaccgcctgctggttgagcgcaccgaagaagccatgatgcgttccatccgtgcagcaaagcctggacgtgaaatcaacgtcattgggcgtgtcattgagtcttacgccaagcgttttggctacaacgtggtccgcgatttcaccggacacggcatcggcccaactttccacaacggccttgtggtgctgcactacgacaacactcagtaccgcgatctgctcgtgccaggcatgaccttgaccatcgagccaatgatcaaccttggttccctcgactacgagatctgggaagatgattggactgtccaaaacgttgaccgtaagttcagcgcgcagttcgagcacaccattgtcatcaccgaagacggcaatgagatcctcaccctcccagacgattccgtctaaaaacgcctaggccacaagcc

SEQ ID NO: 36 - protein, 291 aa, Corynebacterium glutamicum
MSKMRAPLVPGIPTPIREVPAHIERPEYVWKDEVQEAIGEPFVQAPEVIEKMRETSRIAANSLKIAGEAVKPGVTTDELDRIVHEYTCDMGAYPSDLGYRGFTKSSCISLNEIVCHGIPDSTVIEEGDIVNIDVTAFKHGVHGDCNATFLAGDVSEEHRLLVERTEEAMMRSIRAAKPGREINVIGRVIESYAKRFGYNVVRDFTGHGIGPTFHNGLVVLHYDNTQYRDLLVPGMTLTIEPMINLGSLDYEIWEDDWTVQNVDRKFSAQFEHTIVITEDGNEILTLPDDSV

SEQ ID NO: 37 - DNA, 1644 bp, Corynebacterium glutamicum
  CDS (101)..(1621): RXA01358
gagggtaaaccttatactccgattcgttttgatgtggtggcaatcgttttggatccgcacacggggcgcccagagatcactgtttatgaggatgtggaacatggcgctcggtagaactatatccactgcgcaattaggtgtgcaggcaaaaatcgttcgtgtggaggctaatgttggcccaggattgcctggtacctacattgttggattagcagatactgccatttcagaatctcgggatcgtattaaaactgcggtgcaaaacagtggcttgatgtggccaaagaccaaagtgatcattaacctctcgccggcttccatgcgtaaacaaggttcgcagtgtgatctcgcgatgaccgttgcagttctcgttgcccatggctctaaccccaaagcgaagtttcatgcgcagaacacgttatttctgggtgaggtggcgcttgatggaaccttgctccctgttactggagttcttccagcgctgttggccgcgaaggaggaaggtattggcaagattgtgatcccggagggaaatgcccaagaagcaggactggttgaggatccttcagtctttttggcacattccatcgaccaggtcttgcgatggcttgatggggaagaggcgttgcctcagcctggactattcaatgatgaaaatagcctcaaactgcctgatatgcgtgatgtggtgggacaaccagaagctaggtttgctgcagaagtagctgctgccggtggtcaccacatgctgatgattggccctcccggttctggaaaatccatgatcgccgagcggattcccagcttgcttcccgaactgtcgccccaacaaatgatcgaggcgacggcagtgcattccgttgtggggcgaaccttttcagggccggtgtcgagggctccgtttatttccccacaccacaatgtcagcaaggctgctctgctcggaggtggctcgggatctcctcttccgggtgctatcagcctggcgcatcatggtgtgttgttcctggatgaggttagtgagattccagcgtcaatccttgattctttgaggactccattggaatacggctcgatccgcatcatcagatcccgccatgatgtcaccttccccgcacagttccagctcatcctcgcggccaatccgtgtagatgcggtgcagaacagcctcaagaatgtgtctgttctggctcagctcgcgcgacgtaccttaataatctttcgggtccgttgagggatcgcttggacatggttgttgccacccactctaaaggtgcagtgctgcgtagtgatgacgttgaggcatctgctcccattgctgatcgggtggcacaagctcgtgagagggcagctttccgatggcgccgttctggactgggaaatcttgttaatgcacacgtagatccacacttcttgcggaggaattttgccgcaacagaagacgccatggtgtacctcggcgcgttcctggcggaaggaacaatctcccaacgtggctgcgatcgggccataaaactgggttggaccttgtgcgatttggatggggaacagcagcccaatcttgaccatattgcgcgagccatggagcttcggggcactacatacagtgaggtagcagcatgattgactcccgcttgctggca

SEQ ID NO: 38 - protein, 507 aa, Corynebacterium glutamicum
MALGRTISTAQLGVQAKIVRVEANVGPGLPGTYIVGLADTAISESRDRIKTAVQNSGLMWPKTKVIINLSPASMRKQGSQCDLAMTVAVLVAHGSNPKAKFHAQNTLFLGEVALDGTLLPVTGVLPALLAAKEEGIGKIVIPEGNAQEAGLVEDPSVFLAHSIDQVLRWLDGEEALPQPGLFNDENSLKLPDMRDVVGQPEARFAAEVAAAGGHHMLMIGPPGSGKSMIAERIPSLLPELSPQQMIEATAVHSVVGRTFSGPVSRAPFISPHHNVSKAALLGGGSGSPLPGAISLAHHGVLFLDEVSEIPASILDSLRTPLEYGSIRIIRSRHDVTFPAQFQLILAANPCRCGAEQPQECVCSGSARATYLNNLSGPLRDRLDMVVATHSKGAVLRSDDVEASAPIADRVAQARERAAFRWRRSGLGNLVNAHVDPHFLRRNFAATEDAMVYLGAFLAEGTISQRGCDRAIKLGWTLCDLDGEQQPNLDHIARAMELRGTTYSEVAA

SEQ ID NO: 39 - DNA, 1173 bp, Corynebacterium glutamicum
  CDS (101)..(1150): RXA01458
gccattagagttcatatttaccaatctacaaggcaactatttcctattgctacgatccgaacaacgctgtaagcgaacacaggttgtagggtggatattcgtgaatcgccgaatcaagactctgacgtggggtgctatccctttggtgctgctggcatcgttggtaagcattgaccatattccgggaacaaacatcaacttgagcgtgccttatgccgctgaaggcccaggtcctacgatcaatacgcttggtcaggtcgacggcgaggatgttgtgtccatcagtagtgctgatctggatgagaccgaaggtaacctgaacatgaccactgtgtcggttcgttccggcatgacattgtcgcaggtaatttcccgatggctgtttaccgatgacacaatcgttcccatcgagcaggttttccctcccggccaatccaccgaggaagtcgaagaatccaaccgcaccgcgttcatctcttcggagtcttccgcaacgatcgccgcgatgaattacctcaacattcccgtcgaagttgaagttgcagaagtcctcaccgacagcgccgcaaccggaattttcgaacccggcgacaaacttctcagcatcgacggcaccgcaatctccactcccggcgatgcacaaaccatcgtgcgatcgaaagctcccggcgatgagatcacgatttcctacgagagaaacgatgcggaatctcaagcaaccatcactttgagggaacacccggatgattcttcggtggcgttgttgggtatttcaatgttgtcggtgccttcgagcgcgattgaggttgattacaacttggaagatatcggtggtccgagcgctggcatgatgttttcgttggcggtcgtcgataagctttcgcctggcgcgctgaatggtggcaagtttgtcgctggcactggcaccatcgcggaggacgggtcggtgggcccgattggcggtattgcgcacaaggtgcgcgctgcggaggacgcgggcgcggaagtgtttttgagccctgcggacaattgcgcggaggcgatgagtgcgaagcctcaggatatgacgatcttgaaggtggattcgttgtctcaggcaatcgatcagatggctgcctacaacgagggctctgatttccagacgtgtggctagtttttagacgctgaggtttc

SEQ ID NO: 40 - protein, 350 aa, Corynebacterium glutamicum
VNRRIKTLTWGAIPLVLLASLVSIDHIPGTNINLSVPYAAEGPGPTINTLGQVDGEDVVSISSADLDETEGNLNMTTVSVRSGMTLSQVISRWLFTDDTIVPIEQVFPPGQSTEEVEESNRTAFISSESSATIAAMNYLNIPVEVEVAEVLTDSAATGIFEPGDKLLSIDGTAISTPGDAQTIVRSKAPGDEITISYERNDAESQATITLREHPDDSSVALLGISMLSVPSSAIEVDYNLEDIGGPSAGMMFSLAVVDKLSPGALNGGKFVAGTGTIAEDGSVGPIGGIAHKVRAAEDAGAEVFLSPADNCAEAMSAKPQDMTILKVDSLSQAIDQMAAYNEGSDFQTCG

SEQ ID NO: 41 - DNA, 1119 bp, Corynebacterium glutamicum
  CDS (101)..(1096): RXA01654
cttttgctgttatgaaagtgaactaaagatatctatgcgcagaccggtctcacgccgcgccatttttgcaacatctgttttggttgcgggggtgagcatcatgtcaccttcggccaacgcagctgaggctccggcatcggaatgggtgaatacgacagcgatcgtagatcaagcgaatgctcagttgtcgcagtttggcgtgagtcttgaccgaagtgcagcagaactttttgatgatcaggcaaactcccaaattgatgcagcgctttcaccgtatgccgataaggttccaacctctggcggccaggtagtcgagcaaagtcttcaggttgtggagcaggaagttcaaaaggcactgcccaactatgaaatccgtaccgatctgcaatcccaggtgatgggtgcaactctaggagaggtgctgcaccgagttcctggatcatggtttgatgcgccagcagttcctgaagaatccaggattgtagaggaacagggtaaatccctgtatgggcccggtaccccgatctatctcaacggaaattccatgtgcacgcttgcggtgactggaactgatgcagatgggcgcaagatcggtatcactgcaggtcactgtggaaaatcgggcgatgcagtccgttcggctgactccttctgggtcggcgataccggaacagtggtgtacaacgcgcctaacgctgactactccgtgatcgagttcggttccaatgcagagttgagcaatacctacaacggtgtcaccgcgaatgctgtcggcggtggcgtgactaatggccaagaagtatgcaaaaacggagttgctactggctacacctgtggtttggtgtggactgctgatgagcgcatgacgatgtctcaggtgtgtgcgggtcgtggtgattcgggtgctccgctgattgcagatggtcgtgtggttggtcttgtatctggtggtgtaattcctgattacaacctggcatgcgccactccgttgcagggacctttcttcatgccaacgctgtcagtgaacatggatactgtcctaactgatttggattcgcaggatcttcccggtcgaggttttcagccaactgctggatagaatttagaaaatccgccgtt

SEQ ID NO: 42 - protein, 332 aa, Corynebacterium glutamicum
MSPSANAAEAPASEWVNTTAIVDQANAQLSQFGVSLDRSAAELFDDQANSQIDAALSPYADKVPTSGGQVVEQSLQVVEQEVQKALPNYEIRTDLQSQVMGATLGEVLHRVPGSWFDAPAVPEESRIVEEQGKSLYGPGTPIYLNGNSMCTLAVTGTDADGRKIGITAGHCGKSGDAVRSADSFWVGDTGTVVYNAPNADYSVIEFGSNAELSNTYNGVTANAVGGGVTNGQEVCKNGVATGYTCGLVWTADERMTMSQVCAGRGDSGAPLIADGRVVGLVSGGVIPDYNLACATPLQGPFFMPTLSVNMDTVLTDLDSQDLPGRGFQPTAG

SEQ ID NO: 43 - DNA, 2049 bp, Corynebacterium glutamicum
  CDS (101)..(2026): RXN01868
tgacaggctaccttctggggtggacatgatccccaacgctcaacccacttgtggcaccaaccacaaaccctgtggcggtaaatcccctagagtaggccacatgaaggatctttatcgctttgtcaatggcctgtggcttgacacccacatcattcccgacgatcgcgcggtggacggcacgttccacaagctgcgcgatgatgctgaagaagacgtccatgagatcgtcaaggaagacactggacgcgcaggcacactttatgcctcatttatggatactgacgccatcaacgctgctggtgttgcaccgctcgatgcggatctgaacaggctgtctgttgctaactcatcgtttttcgcagctgctctcggcgaactggaccgtgaaggcgttggcgcgccagtaggtttctgggtggagaaggattcttcctccaacgaatccgtcgcctatgtcatccagtccggcctcggcctgcccgatgaggcttattaccgcgaggaggcacacgccgaaactctcgcggcctacaaagagcacgttgagcgcatgctcggctacttggataacagccgcctcttcggtctgtcggctgcttccgctgccgcacgaattgtcgccctggaaacggaaatcgctgctggccactgggatgtcgtgaagacccgcgacgccgtagccacctacaaccccaccgaactcggcgcgctgccaccaaaggtccgcacgctgctcagttccgcaggcctcccggaccagcgcctggtatcgatgatgccgtcatacctcgaccacctcaacggcttgcttgtcgacgaccgcctccccgattggcagctatgggcaacctggcacatcttgaggtctcgagcaggactgttgaccgaggaaattagccaagcaaacttcgacttctatggcaccaaactgtccggcgccaccgagcaaaaagatcgatggaagcgtgctgtcggcctggcagagcgcatggtgggcgaggaaatcgggcaacgattcgtcgaaaggcattttcctgcaagctccaaggagcacatgcttgagctcgtcgactacctggttgccgcctaccgtgatcgcatttccaacctcgaatggatgacgcccgccacccgcgagcgtgccctggaaaagttgggcaaattcaacgcgaaaatcggctaccccgacaagtggcgctcctacgaaggcctcgaattcggctccgacctggtggacaactcccgcaagggctccgcgttcctccatgactatgagctgggcaagatcggcaaaccagccgaccgcgacgaatgggtcaccaccccacaaaccgtcaacgccttctacaaccccgtggtcaacgacatcaccttccccgcagccatcctgcgcgcaccattcttcgaccccgaagcagaagccgcagaaaacttcggtgcaatcggtgctgtgatcggacacgaaatcggccacggctttgacgatcaaggcagccaatacgacggcgacggcaacctcaactcctggtggaccgacgaagaccgctccgcattcgagcagctcacctcacgtctggtcacccaattcagcggactcgtccctgccgtcctgacctctgaaggaatcgacaccgacggcgtcaacggtgaattcactctcggcgaaaacatcggtgacctcggcggattgggcatcgctgtcgttgcctacgaaaagtacctcgcagaccgtggccaaacctttgaaacctcaccagtccaaaaattcgaagcagaaggcgccgaggaaggcctggccgagcaagaattcaacggtctccaacgcctcttcctgtcctgggctcgcgtgtggcgcaccaaaatccgcccacagatggccgtccaatacctggccatcgacccacactcccctgcagaattccgctgcaatgtcatcgccggaaacgtcgctgaattctacgaagcattcgacgtccccgaagatgcacctgtgtacatcaagccagaagagcgcctagctatctggtagttgttagttggtattgaaaa

SEQ ID NO: 44 - protein, 642 aa, Corynebacterium glutamicum
MKDLYRFVNGLWLDTHIIPDDRAVDGTFHKLRDDAEEDVHEIVKEDTGRAGTLYASFMDTDAINAAGVAPLDADLNRLSVANSSFFAAALGELDREGVGAPVGFWVEKDSSSNESVAYVIQSGLGLPDEAYYREEAHAETLAAYKEHVERMLGYLDNSRLFGLSAASAAARIVALETEIAAGHWDVVKTRDAVATYNPTELGALPPKVRTLLSSAGLPDQRLVSMMPSYLDHLNGLLVDDRLPDWQLWATWHILRSRAGLLTEEISQANFDFYGTKLSGATEQKDRWKRAVGLAERMVGEEIGQRFVERHFPASSKEHMLELVDYLVAAYRDRISNLEWMTPATRERALEKLGKFNAKIGYPDKWRSYEGLEFGSDLVDNSRKGSAFLHDYELGKIGKPADRDEWVTTPQTVNAFYNPVVNDITFPAAILRAPFFDPEAEAAENFGAIGAVIGHEIGHGFDDQGSQYDGDGNLNSWWTDEDRSAFEQLTSRLVTQFSGLVPAVLTSEGIDTDGVNGEFTLGENIGDLGGLGIAVVAYEKYLADRGQTFETSPVQKFEAEGAEEGLAEQEFNGLQRLFLSWARVWRTKIRPQMAVQYLAIDPHSPAEFRCNVIAGNVAEFYEAFDVPEDAPVYIKPEERLAIW

SEQ ID NO: 45 - DNA, 1734 bp, Corynebacterium glutamicum
  CDS (101)..(1711): FRXA01868
atgcggatctgaacaggctgtctgttgctaactcatcgttttcgcagctgctctcggcgaactggaccgtgaaggcgttggcgcgccagtaggtttctgggtggagaaggattcttcctccaacgaatccgtcgcctatgtcatccagtccggcctcggcctgcccgatgaggcttattaccgcgaggaggcacacgccgaaactctcgcggcctacaaagagcacgttgagcgcatgctcggctacttggataacagccgcctcttcggtctgtcggctgcttccgctgccgcacgaattgtcgccctggaaacggaaatcgctgctggccactgggatgtcgtgaagacccgcgacgccgtagccacctacaaccccaccgaactcggcgcgctgccaccaaaggtccgcacgctgctcagttccgcaggcctcccggaccagcgcctggtatcgatgatgccgtcatacctcgaccacctcaacggcttgcttgtcgacgaccgcctccccgattggcagctatgggcaacctggcacatcttgaggtctcgagcaggactgttgaccgaggaaattagccaagcaaacttcgacttctatggcaccaaactgtccggcgccaccgagcaaaaagatcgatggaagcgtgctgtcggcctggcagagcgcatggtgggcgaggaaatcgggcaacgattcgtcgaaaggcattttcctgcaagctccaaggagcacatgcttgagctcgtcgactacctggttgccgcctaccgtgatcgcatttccaacctcgaatggatgacgcccgccacccgcgagcgtgccctggaaaagttgggcaaattcaacgcgaaaatcggctaccccgacaagtggcgctcctacgaaggcctcgaattcggctccgacctggtggacaactcccgcaagggctccgcgttcctccatgactatgagctgggcaagatcggcaaaccagccgaccgcgacgaatgggtcaccaccccacaaaccgtcaacgccttctacaaccccgtggtcaacgacatcaccttccccgcagccatcctgcgcgcaccattcttcgaccccgaagcagaagccgcagaaaacttcggtgcaatcggtgctgtgatcggacacgaaatcggccacggctttgacgatcaaggcagccaatacgacggcgacggcaacctcaactcctggtggaccgacgaagaccgctccgcattcgagcagctcacctcacgtctggtcacccaattcagcggactcgtccctgccgtcctgacctctgaaggaatcgacaccgacggcgtcaacggtgaattcactctcggcgaaaacatcggtgacctcggcggattgggcatcgctgtcgttgcctacgaaaagtacctcgcagaccgtggccaaacctttgaaacctcaccagtccaaaaattcgaagcagaaggcgccgaggaaggcctggccgagcaagaattcaacggtctccaacgcctcttcctgtcctgggctcgcgtgtggcgcaccaaaatccgcccacagatggccgtccaatacctggccatcgacccacactcccctgcagaattccgctgcaatgtcatcgccggaaacgtcgctgaattctacgaagcattcgacgtccccgaagatgcacctgtgtacatcaagccagaagagcgcctagctatctggtagttgttagttggtattgaaaa

SEQ ID NO: 46 - protein, 537 aa, Corynebacterium glutamicum
VEKDSSSNESVAYVIQSGLGLPDEAYYREEAHAETLAAYKEHVERMLGYLDNSRLFGLSAASAAARIVALETEIAAGHWDVVKTRDAVATYNPTELGALPPKVRTLLSSAGLPDQRLVSMMPSYLDHLNGLLVDDRLPDWQLWATWHILRSRAGLLTEEISQANFDFYGTKLSGATEQKDRWKRAVGLAERMVGEEIGQRFVERHFPASSKEHMLELVDYLVAAYRDRISNLEWMTPATRERALEKLGKFNAKIGYPDKWRSYEGLEFGSDLVDNSRKGSAFLHDYELGKIGKPADRDEWVTTPQTVNAFYNPVVNDITFPAAILRAPFFDPEAEAAENFGAIGAVIGHEIGHGFDDQGSQYDGDGNLNSWWTDEDRSAFEQLTSRLVTQFSGLVPAVLTSEGIDTDGVNGEFTLGENIGDLGGLGIAVVAYEKYLADRGQTFETSPVQKFEAEGAEEGLAEQEFNGLQRLFLSWARVWRTKIRPQMAVQYLAIDPHSPAEFRCNVIAGNVAEFYEAFDVPEDAPVYIKPEERLAIW

SEQ ID NO: 47 - DNA, 426 bp, Corynebacterium glutamicum
  CDS (101)..(403): FRXA01869
tgacaggctaccttctggggtggacatgatccccaacgctcaacccacttgtggcaccaaccacaaaccctgtggcggtaaatcccctagagtaggccacatgaaggatctttatcgctttgtcaatggcctgtggcttgacacccacatcattcccgacgatcgcgcggtggacggcacgttccacaagctgcgcgatgatgctgaagaagacgtccatgagatcgtcaaggaagacactggacgcgcaggcacactttatgcctcatttatggatactgacgccatcaacgctgctggtgttgcaccgctcgatgcggatctgaacaggctgtctgttgctaactcatcgttttcgcagctgctctcggcgaactggaccgtgaaggcgttggcgcgccagtaggtttctgggtggagaaggat

SEQ ID NO: 48 - protein, 101 aa, Corynebacterium glutamicum
MKDLYRFVNGLWLDTHIIPDDRAVDGTFHKLRDDAEEDVHEIVKEDTGRAGTLYASFMDTDAINAAGVAPLDADLNRLSVANSSFSQLLSANWTVKALARQ

SEQ ID NO: 49 - DNA, 2898 bp, Corynebacterium glutamicum
  CDS (101)..(2875): RXN03028
ctaattccaagccgagctgaaaaagtctggaagttttgcccaataagggcgttaaagtgggtgaaagcgaatttagaaataaagaattaaggggagagacatgttcgagaggtttaccgatcgtgcacgccgcgtgattgtgctcgcgcaggaagaggcgcgcatgctcaaccacaattacatcggcacggagcacattctcctcggcctcattcacgagggcgagggcgttgcagccaaggctttggaatccatgggaatttccctggacgccgtccgccaggaagtcgaagagattatcggccagggctcccagcccaccaccggccacattccttttactccacgtgccaagaaggtcctggagctcagcctccgcgaaggcctacaaatgggacacaagtacatcggtactgagttcctgcttctcggtttgatccgtgagggcgagggcgttgctgcccaggtcctggtcaagcttggtgctgatctgccacgcgtgcgtcagcaagttattcagcttctctccggctacgaaggtggccagggcggatccccagagggcggccagggcgcccctactggcggtgacgctgttggtgcaggagctgctcctggcggtcgtccatcttcgggcagcccaggcgagcgttctacctctttggtccttgaccagttcggccgcaacctcacccaggctgcaaaggacggcaagctggatccagttgttggtcgcgataaggaaatcgagcgcatcatgcaggtgctctcccgtcgtaccaagaacaacccagttcttattggtgagccaggtgttggtaagaccgcagttgttgaaggtcttgcactagacattgttaacggcaaggttccagagaccctcaaggacaagcaggtttactcccttgacttaggttccctggttgcaggttcccgttaccgcggtgacttcgaagagcgactgaagaaggtcctcaaggagattaaccagcgcggcgacatcatcctgtttatcgatgagatccacaccctcgtgggtgcaggtgcagcagaaggcgcaatcgacgctgcctccctgcttaagccaaagcttgcccgcggtgaactgcagaccattggtgcaaccaccctggatgagtaccgtaagcacattgaaaaggacgcagctcttgagcgtcgtttccagccagtgcaggttccagagccttcggttgatctcaccgttgagatcttgaagggtctgcgcgaccgctacgaagctcaccaccgcgtatccatcaccgatggtgctcttactgcagcagctcagcttgctgatcgctacatcaacgaccgcttcttgccagataaggccgttgacctcatcgatgaggctggcgcccgcatgcgcatcaagcgcatgaccgcaccttcctccctccgcgaggttgatgagcgtatcgctgatgttcgccgtgagaaggaagcagcgatcgatgctcaggactttgagaaggcagcaggtcttcgcgataaggagcgcaagctcggcgaagagcgttcagagaaggaaaagcagtggcgctccggcgacctcgaggacatcgctgaggttggcgaagagcagatcgcagaagtactggccaactggactggtattcctgtcttcaagctcaccgaagctgaatcttcacgcctgctcaacatggaagaagagttgcacaagcgcatcatcggacaggatgaagctgtcaaggctgtctcccgtgcgatccgtcgtacccgtgcaggtctgaaggatcctaagcgtccttccggctccttcatcttcgctggtccatccggcgttggtaagaccgagctgtccaaggctctcgcaggattcctcttcggtgacgatgattccctcatccaaatcgacatgggtgagttccacgaccgcttcaccgcgtcccgacttttcggtgcccctccgggatacgttggctacgaagaaggtggccagctgaccgagaaggttcgccgtaagccattctccgttgtgcttttcgacgaaatcgagaaggcccacaaggagatctacaacaccttgctgcaggtgttggaagatggtcgccttaccgatggtcagggacgcatcgtggacttcaagaacaccgtcctgatcttcacctccaacctgggcaccgctgacatctccaaggctgttggcctgggcttctccggatcctccgagactgacagcgatgctcagtacgaccgcatgaagaacaaggtccacgacgagctgaagaagcacttccgccctgagttcctgaaccgtattgatgagatcgtggtcttccaccagctcaccaaggatcagatcgttcagatggtcgaccttcttatcggtcgcgtttccaacgcactggctgagaaggacatgagcatcgaactgactgagaaggccaaggacctcctggctaaccgaggcttcgatccagttctgggtgcacgaccattgcgtcgcaccatccagcgcgaaattgaagaccagatgtccgagaagatcctcttcggtgaaatcggcgcaggcgagatcgtcaccgttgacgtcgaaggctgggacggcgagtccaaggacaccgaccgtgcgaagttcaccttcacaccacgtccaaagccaatgccagaaggtaagttctctgagatctctgtcgaggctgcggaagcaattcaagatgtagattctgcagctgacggcgatgtcccagaaaccgattcactttccgacattgaccttgaaacccttgaaaagtttgaggaagatgtagaaaacggcaccgacattgatcaggtgtccggtgactactacggcaccgatgatcagggaggcactgctccaagcaaggagtagcaaccttttgaaaaagggcc

SEQ ID NO: 50 - protein, 925 aa, Corynebacterium glutamicum
MFERFTDRARRVIVLAQEEARMLNHNYIGTEHILLGLIHEGEGVAAKALESMGISLDAVRQEVEEIIGQGSQPTTGHIPFTPRAKKVLELSLREGLQMGHKYIGTEFLLLGLIREGEGVAAQVLVKLGADLPRVRQQVIQLLSGYEGGQGGSPEGGQGAPTGGDAVGAGAAPGGRPSSGSPGERSTSLVLDQFGRNLTQAAKDGKLDPVVGRDKEIERIMQVLSRRTKNNPVLIGEPGVGKTAVVEGLALDIVNGKVPETLKDKQVYSLDLGSLVAGSRYRGDFEERLKKVLKEINQRGDIILFIDEIHTLVGAGAAEGAIDAASLLKPKLARGELQTIGATTLDEYRKHIEKDAALERRFQPVQVPEPSVDLTVEILKGLRDRYEAHHRVSITDGALTAAAQLADRYINDRFLPDKAVDLIDEAGARMRIKRMTAPSSLREVDERIADVRREKEAAIDAQDFEKAAGLRDKERKLGEERSEKEKQWRSGDLEDIAEVGEEQIAEVLANWTGIPVFKLTEAESSRLLNMEEELHKRIIGQDEAVKAVSRAIRRTRAGLKDPKRPSGSFIFAGPSGVGKTELSKALAGFLFGDDDSLIQIDMGEFHDRFTASRLFGAPPGYVGYEEGGQLTEKVRRKPFSVVLFDEIEKAHKEIYNTLLQVLEDGRLTDGQGRIVDFKNTVLIFTSNLGTADISKAVGLGFSGSSETDSDAQYDRMKNKVHDELKKHFRPEFLNRIDEIVVFHQLTKDQIVQMVDLLIGRVSNALAEKDMSIELTEKAKDLLANRGFDPVLGARPLRRTIQREIEDQMSEKILFGEIGAGEIVTVDVEGWDGESKDTDRAKFTFTPRPKPMPEGKFSEISVEAAEAIQDVDSAADGDVPETDSLSDIDLETLEKFEEDVENGTDIDQVSGDYYGTDDQGGTAPSKE

SEQ ID NO: 51 - DNA, 1104 bp, Corynebacterium glutamicum
  CDS (101)..(1081): FRXA02470
ctaattccaagccgagctgaaaaagtctggaagttttgcccaataagggcgttaaagtgggtgaaagcgaatttagaaataaagaattaaggggagagacatgttcgagaggtttaccgatcgtgcacgccgcgtgattgtgctcgcgcaggaagaggcgcgcatgctcaaccacaattacatcggcacggagcacattctcctcggcctcattcacgagggcgagggcgttgcagccaaggctttggaatccatgggaatttccctggacgccgtccgccaggaagtcgaagagattatcggccagggctcccagcccaccaccggccacattccttttactccacgtgccaagaaggtcctggagctcagcctccgcgaaggcctacaaatgggacacaagtacatcggtactgagttcctgcttctcggtttgatccgtgagggcgagggcgttgctgcccaggtcctggtcaagcttggtgctgatctgccacgcgtgcgtcagcaagttattcagcttctctccggctacgaaggtggccagggcggatccccagagggcggccagggcgcccctactggcggtgacgctgttggtgcaggagctgctcctggcggtcgtccatcttcgggcagcccaggcgagcgttctacctctttggtccttgaccagttcggccgcaacctcacccaggctgcaaaggacggcaagctggatccagttgttggtcgcgataaggaaatcgagcgcatcatgcaggtgctctcccgtcgtaccaagaacaacccagttcttattggtgagccaggtgttggtaagaccgcagttgttgaaggtcttgcactagacattgttaacggcaaggttccagagaccctcaaggacaagcaggtttactcccttgacttaggttccctggttgcaggttcccgttaccgcggtgacttcgaagagcgactgaagaaggtcctcaaggagattaaccagcgcggcgacatcatcctgtttatcgatgagatccacaccctcgtgggtgcaggtgcagcacgaaggcgcaatcgacgctgcctccctgcttaagccaaagcttgcccgcggtg

SEQ ID NO: 52 - protein, 327 aa, Corynebacterium glutamicum
MFERFTDRARRVIVLAQEEARMLNHNYIGTEHILLGLIHEGEGVAAKALESMGISLDAVRQEVEEIIGQGSQPTTGHIPFTPRAKKVLELSLREGLQMGHKYIGTEFLLLGLIREGEGVAAQVLVKLGADLPRVRQQVIQLLSGYEGGQGGSPEGGQGAPTGGDAVGAGAAPGGRPSSGSPGERSTSLVLDQFGRNLTQAAKDGKLDPVVGRDKEIERIMQVLSRRTKNNPVLIGEPGVGKTAVVEGLALDIVNGKVPETLKDKQVYSLDLGSLVAGSRYRGDFEERLKKVLKEINQRGDIILFIDEIHTLVGAGAARRRNRRCLPA

SEQ ID NO: 53 - DNA, 1956 bp, Corynebacterium glutamicum
  CDS (101)..(1933): FRXA02471
ggtgacttcgaagagcgactgaagaaggtcctcaaggagattaaccagcgcggcgacatcatcctgtttatcgatgagatccacaccctcgtgggtgcaggtgcagcacgaaggcgcaatcgacgctgcctccctgcttaagccaaagcttgcccgcggtgaactgcagaccattggtgcaaccaccctggatgagtaccgtaagcacattgaaaaggacgcagctcttgagcgtcgtttccagccagtgcaggttccagagccttcggttgatctcaccgttgagatcttgaagggtctgcgcgaccgctacgaagctcaccaccgcgtatccatcaccgatggtgctcttactgcagcagctcagcttgctgatcgctacatcaacgaccgcttcttgccagataaggccgttgacctcatcgatgaggctggcgcccgcatgcgcatcaagcgcatgaccgcaccttcctccctccgcgaggttgatgagcgtatcgctgatgttcgccgtgagaaggaagcagcgatcgatgctcaggactttgagaaggcagcaggtcttcgcgataaggagcgcaagctcggcgaagagcgttcagagaaggaaaagcagtggcgctccggcgacctcgaggacatcgctgaggttggcgaagagcagatcgcagaagtactggccaactggactggtattcctgtcttcaagctcaccgaagctgaatcttcacgcctgctcaacatggaagaagagttgcacaagcgcatcatcggacaggatgaagctgtcaaggctgtctcccgtgcgatccgtcgtacccgtgcaggtctgaaggatcctaagcgtccttccggctccttcatcttcgctggtccatccggcgttggtaagaccgagctgtccaaggctctcgcaggattcctcttcggtgacgatgattccctcatccaaatcgacatgggtgagttccacgaccgcttcaccgcgtcccgacttttcggtgcccctccgggatacgttggctacgaagaaggtggccagctgaccgagaaggttcgccgtaagccattctccgttgtgcttttcgacgaaatcgagaaggcccacaaggagatctacaacaccttgctgcaggtgttggaagatggtcgccttaccgatggtcagggacgcatcgtggacttcaagaacaccgtcctgatcttcacctccaacctgggcaccgctgacatctccaaggctgttggcctgggcttctccggatcctccgagactgacagcgatgctcagtacgaccgcatgaagaacaaggtccacgacgagctgaagaagcacttccgccctgagttcctgaaccgtattgatgagatcgtggtcttccaccagctcaccaaggatcagatcgttcagatggtcgaccttcttatcggtcgcgtttccaacgcactggctgagaaggacatgagcatcgaactgactgagaaggccaaggacctcctggctaaccgaggcttcgatccagttctgggtgcacgaccattgcgtcgcaccatccagcgcgaaattgaagaccagatgtccgagaagatcctcttcggtgaaatcggcgcaggcgagatcgtcaccgttgacgtcgaaggctgggacggcgagtccaaggacaccgaccgtgcgaagttcaccttcacaccacgtccaaagccaatgccagaaggtaagttctctgagatctctgtcgaggctgcggaagcaattcaagatgtagattctgcagctgacggcgatgtcccagaaaccgattcactttccgacattgaccttgaaacccttgaaaagtttgaggaagatgtagaaaacggcaccgacattgatcaggtgtccggtgactactacggcaccgatgatcagggaggcactgctccaagcaaggagtagcaaccttttgaaaaagggcc

SEQ ID NO: 54 - protein, 611 aa, Corynebacterium glutamicum
VQHEGAIDAASLLKPKLARGELQTIGATTLDEYRKHIEKDAALERRFQPVQVPEPSVDLTVEILKGLRDRYEAHHRVSITDGALTAAAQLADRYINDRFLPDKAVDLIDEAGARMRIKRMTAPSSLREVDERIADVRREKEAAIDAQDFEKAAGLRDKERKLGEERSEKEKQWRSGDLEDIAEVGEEQIAEVLANWTGIPVFKLTEAESSRLLNMEEELHKRIIGQDEAVKAVSRAIRRTRAGLKDPKRPSGSFIFAGPSGVGKTELSKALAGFLFGDDDSLIQIDMGEFHDRFTASRLFGAPPGYVGYEEGGQLTEKVRRKPFSVVLFDEIEKAHKEIYNTLLQVLEDGRLTDGQGRIVDFKNTVLIFTSNLGTADISKAVGLGFSGSSETDSDAQYDRMKNKVHDELKKHFRPEFLNRIDEIVVFHQLTKDQIVQMVDLLIGRVSNALAEKDMSIELTEKAKDLLANRGFDPVLGARPLRRTIQREIEDQMSEKILFGEIGAGEIVTVDVEGWDGESKDTDRAKFTFTPRPKPMPEGKFSEISVEAAEAIQDVDSAADGDVPETDSLSDIDLETLEKFEEDVENGTDIDQVSGDYYGTDDQGGTAPSKE

SEQ ID NO: 55 - DNA, 1446 bp, Corynebacterium glutamicum
  CDS (101)..(1423): RXA02630
gcgggttcgaaaatgtcgatgattaaaccactaaagagctcacaggaagtgttcagactacttagagtgacgccccagccacagggttcataatcaaatcatgacaaatcaattccccacaaacaacggtgagaacccggaccgtgcatcggaaactccatcagaaaccaactccttcgaacatgtgcgtagttcatatccgcagtggggtaacactgcttccaatcaaaacccctatcctggtgcgggcttcggctctgaacaaaacactcaacaaggaaatgagcaacaagctccagcctggaccagttgggataatcagcctctaagcacagatgtaaagccagctaaagaaaagcgaaaagttggcatcggaacggcactcgcgttaatgcttgttggttctattgctaccggtagcgttgtgggtgttgcagcaacccagcttggttcggactcttcaaccccagttaatgctcttgagcagcccagcgtgcagcgcaccactaatgctgaaccaggttcagcggaacaggttgctgccgcagttttgccttctgtcgtctctattcaggccattactaggacgtctgcttctgagggctctggatccattatttcctctgatggttacgtcatgaccaataatcacgtcgtggcaggcattgaacaatctggtgtgttagaagtaagtttctccgatggaactacagcgcaagctgattttattgctggtgatccttccacagatattgctgtgatcaagattagggatgtgtccaaccttccagttatgagctttggagattcggacgcattaggcgttggacaaagtgtgatggctgttggttctccactgggtctgagctccactgtgaccaccggtattgtgtcggccgtgaaccgtcctgtgcgagcttctggtgatggcggagagtcgtccctcatcgatgctatccagaccgatgctgcgatcaaccctggtaactctggtggtccgctggttgatatggatggcaacctcattggcatgaattcggtaattgcatcgatttcgagcaccagcgattccgcaggttccattggtcttggtttttctatcccatccaactttgccaagcgcgtggccgatcaattgatcagcaccggccaggtaactcagccgatgatcggtgtgcaggttggcactgacaactcagtgacaggcgctgtgattgccagtgttcaagatggtggaccggccgcagatgctggacttcagccaggcgatatcgtgaccaagctcaatgatcgagttattgatagcccagactccttgatcgctgctgttcgttcgcatgattttggcgaaaccgtcactttaacaattacacagccagatacctcgcagagccgggaggtagaggttactctgacgagtgagtaggtttaaaagagttaatctgc

SEQ ID NO: 56 - protein, 441 aa, Corynebacterium glutamicum
MTNQFPTNNGENPDRASETPSETNSFEHVRSSYPQWGNTASNQNPYPGAGFGSEQNTQQGNEQQAPAWTSWDNQPLSTDVKPAKEKRKVGIGTALALMLVGSIATGSVVGVAATQLGSDSSTPVNALEQPSVQRTTNAEPGSAEQVAAAVLPSVVSIQAITRTSASEGSGSIISSDGYVMTNNHVVAGIEQSGVLEVSFSDGTTAQADFIAGDPSTDIAVIKIRDVSNLPVMSFGDSDALGVGQSVMAVGSPLGLSSTVTTGIVSAVNRPVRASGDGGESSLIDAIQTDAAINPGNSGGPLVDMDGNLIGMNSVIASISSTSDSAGSIGLGFSIPSNFAKRVADQLISTGQVTQPMIGVQVGTDNSVTGAVIASVQDGGPAADAGLQPGDIVTKLNDRVIDSPDSLIAAVRSHDFGETVTLTITQPDTSQSREVEVTLTSE

SEQ ID NO: 57 - DNA, 518 bp, Corynebacterium glutamicum
  CDS (1)..(495): RXA02834
gattctaaaggtagaagtgttgactttaaaaataccattatcatcatgactagtaatattggttcacaagtattacttgaaaatgtaaaagatgctggtgaaattagtgatgatacagagaaagcagttatggacagtctacatgcatacttcaaacctgaaatattaaatcgtatggatgacatcgtgttatttaaaccattatcagttaatgatatgagtatgattgtagataaaattttaacacaattaaatatgagattattagatcaacatatctcaattgaagtgacagaagaagcgaaaaaatggctaggtgaagaagcgtatgaaccacaatttggtgcaagaccattaaaacgctttgttcaacgacaaatagaaactccaattgcacgtatgatgattaaagaaagtctacctgaaggtacaataattaaagtagatttaaatgacaataaagaacttgattttaaggttgttaaacctacgtcttaatctagcaaaatattaatttg

SEQ ID NO: 58 - protein, 165 aa, Corynebacterium glutamicum
DSKGRSVDFKNTIIIMTSNIGSQVLLENVKDAGEISDDTEKAVMDSLHAYFKPEILNRMDDIVLFKPLSVNDMSMIVDKILTQLNMRLLDQHISIEVTEEAKKWLGEEAYEPQFGARPLKRFVQRQIETPIARMMIKESLPEGTIIKVDLNDNKELDFKVVKPTS

SEQ ID NO: 59 - DNA, 1314 bp, Corynebacterium glutamicum
  CDS (101)..(1291): RXA00112
gcgttaggctgacgggctccggtggcctaaaatcgaagcgatctaaaaatttggcagttaatattatcgattttcgaaagcgtagaacaccaaaccattgttgagccccagcctggtcgtcgatgccgtcatcgtcctcgttatggcattcgccctgtggggtggttggcgtcaaggcgccttcacctcgctgctgtccaccgtcggcgtcgtttctggcctggtagttggcgcagcagcagctccatttgtcatgggtctcaccgattccaccgcgcttcgcttcctcctggcgatcggcaccgtggtgctgctggttggtttgggaaatctcatcggcgcccacttgggtgctgcgattagagacaacatcaaattccgaagttccaggaccttagattctgggctcggcgccattttccaagtattggccaccttgatcgtggtgtggctcgtcgcaattcccctggccacaggcctccccggaactgtcgccagcggaattagagactcccgcatcctgggctttgtagacaaatacaccccgcaaggcctagataccctgccctccaaaatcgctgcgatgctcagcgaatccggcctcccaccactgatttcccccttcaccggcggatcctcggtggaagtggacgcccccgaaatcaacgtcaccaacgttgacctagtcgaagcaatgcgcccgtccgtcatccacgtgatgggtgacgcccaagaatgcagccgccgactcatgggttctggctttgtggcatcccccgactacgttgtgaccaacgcccacgttgttgcaggtacctccaccgtcagcctggataccatgatcggaacccgctccgcagaggtagtgttctacgacccgaacctggacatcgcagtcctttacagccctgacctcggcttggatccactgccgtgggcatccactccgctagacactggcgatgaagcaatcgtcatgggattcccacagtccggacctttcaacgcctccccagccagggtccgcgaacgcatcatgatcaccggcagcaacatttacgccaacggccagcacgaacgcgaagcctattcagtccgcggatccatccaatctggaaactccggcggcccaatgaccaacgaaatgggtgaagtggttggtgttgtcttcggcgcagcgatcgacggctccgataccggttacgttctcactgccgaagaggtacaggagcggatcggcgacatcaccgcgctgactcagcctgtcgatacgatgcagtgcgcggtttcttagtcgtcgggagctaggaccag

SEQ ID NO: 60 - protein, 397 aa, Corynebacterium glutamicum
LSPSLVVDAVIVLVMAFALWGGWRQGAFTSLLSTVGVVSGLVVGAAAAPFVMGLTDSTALRFLLAIGTVVLLVGLGNLIGAHLGAAIRDNIKFRSSRTLDSGLGAIFQVLATLIVVWLVAIPLATGLPGTVASGIRDSRILGFVDKYTPQGLDTLPSKIAAMLSESGLPPLISPFTGGSSVEVDAPEINVTNVDLVEAMRPSVIHVMGDAQECSRRLMGSGFVASPDYVVTNAHVVAGTSTVSLDTMIGTRSAEVVFYDPNLDIAVLYSPDLGLDPLPWASTPLDTGDEAIVMGFPQSGPFNASPARVRERIMITGSNIYANGQHEREAYSVRGSIQSGNSGGPMTNEMGEVVGVVFGAAIDGSDTGYVLTAEEVQERIGDITALTQPVDTMQCAVS

SEQ ID NO: 61 - DNA, 729 bp, Corynebacterium glutamicum
  CDS (101)..(706): RXA00566
cttgttgaccacgtgattaccttggctgaaggcccaatcagcaactaggcgcacggaaaactttaaaggagagaataagattatgagcagcggattccaaatgccaacgtcccgttacgtgctgccttccttcattgagcagtccgcatacggcaccaaagagaccaacccttacgcaaaactctttgaagagcgcatcatcttcctgggcacccaggtcgacgacacctctgcaaacgacatcatggcgcagctccttgtcctcgaaggcatggacccagaccgcgatatcaccctgtacatcaactcacctggtggatccttcaccgcgttgatggcaatttacgacaccatgcagtacgtccgcccagacgttcagaccgtctgccttggtcaggcagcatccgcagccgcagttcttcttgcagccggtgcaccaggtaagcgcgctgttcttcctaactcccgcgtgctgatccaccagccagcaacccagggcacccagggtcaggtttctgacctcgagatccaggcagctgaaatcgagcgcatgcgtcgtttgatggaaaccaccttggctgagcacaccggcaagaccgcggagcagatccgcatcgataccgaccgtgacaagatcctcaccgctgaggaagcactcgagtatggcatcgttgaccaggtcttcgattaccgcaagctcaagcgctagagttttttaaagattcgggt

SEQ ID NO: 62 - protein, 202 aa, Corynebacterium glutamicum
MPTSRYVLPSFIEQSAYGTKETNPYAKLFEERIIFLGTQVDDTSANDIMAQLLVLEGMDPDRDITLYINSPGGSFTALMAIYDTMQYVRPDVQTVCLGQAASAAAVLLAAGAPGKRAVLPNSRVLIHQPATQGTQGQVSDLEIQAAEIERMRRLMETTLAEHTGKTAEQIRIDTDRDKILTAEEALEYGIVDQVFDYRKLKR

SEQ ID NO: 63 - DNA, 714 bp, Corynebacterium glutamicum
  CDS (101)..(691): RXA00567
cgaacagaggcggtttcatggaaataccgccgggtagtctggtgacattgaaccaaatgaacgtacccaagatttaagaatgtaggagttgactgttttcatgagcgatattcgtatggcagcccagggtgggcctggtttcggaaatgacgtctttgatcgcctcatgagtgagcgcatcattttcctgggaagccaggtagacgatgagattgcaaacaagctatgcgctcagatcctgctgctgtccgctgaggatccaaccagggacatctccctgtacattaactccccaggtggctccgtcaccgcaggcatggcaatttatgacaccatgaaatactccccatgcgacatcgcaacctacggcatgggcctggcagcatccatgggccagttcctgctttccggtggcactaagggcaagcgtttcgcattgccacacgcacgtatcatgatgcaccagccttccgctggtgttggtggtaccgcagctgatatcgctatccaggctgagcagttcgcagccaccaagcgtgaaatggcccagctgatcgctgagcacaccggccagacctttgagcagatctccaaggattccgatcgtgaccgctggttcactgcacaggaagctaaggattacggacttgttgaccacgtgattaccttggctgaaggcccaatcagcaactaggcgcacggaaaactttaaag

SEQ ID NO: 64 - protein, 197 aa, Corynebacterium glutamicum
MSDIRMAAQGGPGFGNDVFDRLMSERIIFLGSQVDDEIANKLCAQILLLSAEDPTRDISLYINSPGGSVTAGMAIYDTMKYSPCDIATYGMGLAASMGQFLLSGGTKGKRFALPHARIMMHQPSAGVGGTAADIAIQAEQFAATKREMAQLIAEHTGQTFEQISKDSDRDRWFTAQEAKDYGLVDHVITLAEGPISN

SEQ ID NO: 65 - DNA, 1875 bp, Corynebacterium glutamicum
  CDS (101)..(1852): RXN03094
atagatattagagagttaaataatggcgcttgacctgcaggaaattgagatcaacactgattgtgtaggttggcgcccaacaaagaaagggcgttgaaagatgagttcattcaatccaactaccaaaaccaatgaagccatgcaggctgctcttcagcaggcatcctcggctggcaaccctgatattcgtccagctcacctgttggctgccatcttggagcaaactgatggcgtagcagcgccagtcctcatggctactggtgtggatcctaaggagatcctcgcagaggccaagaagttggttgcttcttaccccaaggcttctggcgccaatatggctaatccaaacttcaaccgggatgccctcaatgcgttcactgcagctcaggagcttgccggtgagttgggcgatgagtacgtctcaaccgaagtacttcttgccggtatcgctcgcggaaagtctgatgctgcggatctgttgaccaacaagggtgcaacctatgacgccatcaaagaggctttcccttcggttcgtggatctcagcgtgtcaccactcaggatccagagggacagttccaggctttggaaaagtactccactgacctgaccaagcttgctcgtgaaggcaagattgatcctgttattggccgtgaccaggaaattcgtcgcgtcgttcaggtgcttagccgtcgtaccaagaacaaccctgttctgatcggtgagccaggtgtcggtaaaaccgccatcgtggaaggccttgcacgccgcatcgttgctggtgacgttccagaatccctcaagggcaaaactctgatcagtcttgatcttggttccatggttgccggcgctaagtatcgcggtgaattcgaggagcgactgaaggctgttctggatgagatcaagggagctaacggcgaagtcgttaccttcatcgatgagctgcacaccatcgtcggcgctggtgcttcgggtgaatccgccatggatgccggaaacatgattaagccactgcttgcccgcggtgagctgcgcttggttggtgccaccacgctgaatgagtaccgcaagtacatcgaaaaggacgctgccctggagcgtaggttccagcaggtttatgtcggtgagccaacggtagaagatgccatcggtattcttcgtggattgaaggaacgctacgaggtccatcacggtgtccgcatccaggactccgcactggtcgccgcagctgaactctcaaaccgctatatcaccagccgtttccttcctgataaggctattgacttagttgatgaggcagcatcacgcctgcgcatggagattgattcttcacctcaggaaatcgatgagctggagcgtatcgtccgccgcctcgagatcgaagagatggcgctgtccaaggaatccgatgcagcttccaaggaacgtctagaaaagctgcgctcggaacttgctgatgaacgcgaaaagctctctgagttgaaggctcgttggcagaatgagaaaactgctattgacgatgtccgggagatgaaagaagagctggaagcgctgcgttctgagtcggatattgcaaaacgtgacggcaattattgtcgtgtcgcaaagcttcgctacggccgaatccctgagctggaaaagcagatcgaggatgcagaatccaaggtcgaggtcaatgaaaatgccatgctcactgaggaggtcacgccagacacgatcgccgatgtggtttccgcatggacgggcattcctgcaggcaagatgatgcagggtgagaccgagaagctgctcaacatggagcgcgtcttgggcaaccgtgtggtcggtcagctagaaagcggtaactgcagtgtctgacgcggtgcgtcgttcacgcg

SEQ ID NO: 66 - protein, 584 aa, Corynebacterium glutamicum
MSSFNPTTKTNEAMQAALQQASSAGNPDIRPAHLLAAILEQTDGVAAPVLMATGVDPKEILAEAKKLVASYPKASGANMANPNFNRDALNAFTAAQELAGELGDEYVSTEVLLAGIARGKSDAADLLTNKGATYDAIKEAFPSVRGSQRVTTQDPEGQFQALEKYSTDLTKLAREGKIDPVIGRDQEIRRVVQVLSRRTKNNPVLIGEPGVGKTAIVEGLARRIVAGDVPESLKGKTLISLDLGSMVAGAKYRGEFEERLKAVLDEIKGANGEVVTFIDELHTIVGAGASGESAMDAGNMIKPLLARGELRLVGATTLNEYRKYIEKDAALERRFQQVYVGEPTVEDAIGILRGLKERYEVHHGVRIQDSALVAAAELSNRYITSRFLPDKAIDLVDEAASRLRMEIDSSPQEIDELERIVRRLEIEEMALSKESDAASKERLEKLRSELADEREKLSELKARWQNEKTAIDDVREMKEELEALRSESDIAKRDGNYCRVAKLRYGRIPELEKQIEDAESKVEVNENAMLTEEVTPDTIADVVSAWTGIPAGKMMQGETEKLLNMERVLGNRVVGQLESGNCSV

SEQ ID NO: 67 - DNA, 1816 bp, Corynebacterium glutamicum
  CDS (101)..(1816): FRXA01668
atagatattagagagttaaataatggcgcttgacctgcaggaaattgagatcaacactgattgtgtaggttggcgcccaacaaagaaagggcgttgaaagatgagttcattcaatccaactaccaaaaccaatgaagccatgcaggctgctcttcagcaggcatcctcggctggcaaccctgatattcgtccagctcacctgttggctgccatcttggagcaaactgatggcgtagcagcgccagtcctcatggctactggtgtggatcctaaggagatcctcgcagaggccaagaagttggttgcttcttaccccaaggcttctggcgccaatatggctaatccaaacttcaaccgggatgccctcaatgcgttcactgcagctcaggagcttgccggtgagttgggcgatgagtacgtctcaaccgaagtacttcttgccggtatcgctcgcggaaagtctgatgctgcggatctgttgaccaacaagggtgcaacctatgacgccatcaaagaggctttcccttcggttcgtggatctcagcgtgtcaccactcaggatccagagggacagttccaggctttggaaaagtactccactgacctgaccaagcttgctcgtgaaggcaagattgatcctgttattggccgtgaccaggaaattcgtcgcgtcgttcaggtgcttagccgtcgtaccaagaacaaccctgttctgatcggtgagccaggtgtcggtaaaaccgccatcgtggaaggccttgcacgccgcatcgttgctggtgacgttccagaatccctcaagggcaaaactctgatcagtcttgatcttggttccatggttgccggcgctaagtatcgcggtgaattcgaggagcgactgaaggctgttctggatgagatcaagggagctaacggcgaagtcgttaccttcatcgatgagctgcacaccatcgtcggcgctggtgcttcgggtgaatccgccatggatgccggaaacatgattaagccactgcttgcccgcggtgagctgcgcttggttggtgccaccacgctgaatgagtaccgcaagtacatcgaaaaggacgctgccctggagcgtaggttccagcaggtttatgtcggtgagccaacggtagaagatgccatcggtattcttcgtggattgaaggaacgctacgaggtccatcacggtgtccgcatccaggactccgcactggtcgccgcagctgaactctcaaaccgctatatcaccagccgtttccttcctgataaggctattgacttagttgatgaggcagcatcacgcctgcgcatggagattgattcttcacctcaggaaatcgatgagctggagcgtatcgtccgccgcctcgagatcgaagagatggcgctgtccaaggaatccgatgcagcttccaaggaacgtctagaaaagctgcgctcggaacttgctgatgaacgcgaaaagctctctgagttgaaggctcgttggcagaatgagaaaactgctattgacgatgtccgggagatgaaagaagagctggaagcgctgcgttctgagtcggatattgcaaaacgtgacggcaattattgtcgtgtcgcaaagcttcgctacggccgaatccctgagctggaaaagcagatcgaggatgcagaatccaaggtcgaggtcaatgaaaatgccatgctcactgaggaggtcacgccagacacgatcgccgatgtggtttccgcatggacgggcattcctgcaggcaagatgatgcagggtgagaccgagaagctgctcaacatggagcgcgtcttgggcaacccg

SEQ ID NO: 68 - protein, 572 aa, Corynebacterium glutamicum
MSSFNPTTKTNEAMQAALQQASSAGNPDIRPAHLLAAILEQTDGVAAPVLMATGVDPKEILAEAKKLVASYPKASGANMANPNFNRDALNAFTAAQELAGELGDEYVSTEVLLAGIARGKSDAADLLTNKGATYDAIKEAFPSVRGSQRVTTQDPEGQFQALEKYSTDLTKLAREGKIDPVIGRDQEIRRVVQVLSRRTKNNPVLIGEPGVGKTAIVEGLARRIVAGDVPESLKGKTLISLDLGSMVAGAKYRGEFEERLKAVLDEIKGANGEVVTFIDELHTIVGAGASGESAMDAGNMIKPLLARGELRLVGATTLNEYRKYIEKDAALERRFQQVYVGEPTVEDAIGILRGLKERYEVHHGVRIQDSALVAAAELSNRYITSRFLPDKAIDLVDEAASRLRMEIDSSPQEIDELERIVRRLEIEEMALSKESDAASKERLEKLRSELADEREKLSELKARWQNEKTAIDDVREMKEELEALRSESDIAKRDGNYCRVAKLRYGRIPELEKQIEDAESKVEVNENAMLTEEVTPDTIADVVSAWTGIPAGKMMQGETEKLLNMERVLGNP

SEQ ID NO: 69 - DNA, 1401 bp, Corynebacterium glutamicum
  CDS (101)..(1378): RXN01120
acaggtaaagcgctaagatggaacaacccattgccaatattgttggttagagttgtacgcagtaaatcttttcaatcgtggaagcgggtctcacagtctaatggcacgtatgcaggaaagcgccgatctgctcaaatgttccttctgcggaaagagccaaaagcaggtaaaaaaactcatcgcgggtggcgccgtatatatctgtgatgagtgcattgagctgtgcaacgagattattgaagaagaactcggtcaagctcaacacgacgagcaggagcgcaacgagctccccaagccgtcggagatttcagccttccttgatacttatgtcatcgggcaggacccagcaaaacgtatcctgtcggttgcggtgtacaaccattacaagcgtctccgcgcatcggaaaccatcggtcgtcgcaggaatgacgagcctgaaaccgaactggttaagtccaatattttgatgctcggccccactggctccggcaagactttccttgcccagactttggcaaagctgctggatgttccttttgctatcgcggatgccacctcactgaccgaggctggttatgtgggcgaggatgtggaaaacatcttgctcaagctgcttcaggctgctgattttgatgtggaacgtgcacagcgcggcatcatttacatcgatgaagtggacaagatttcccgcaagtctgaaaacccatcgatcactcgcgatgtttccggtgaaggcgtgcagcaggcactgctgaaaattttggaaggcactgtcgccgcaatcccaccgcagggaggacgcaagcaccccaaccaggatttcatccagctggataccaccaacattttgttcatcgttgctggtgcgttctctggtctggagaaggtcatcgcggaccgcaatggcaagaaaggcttgggcttcggtgtggaggtctcttccaagaaggaagaagccaacattgtggatatcttcaaggatgtcctccctgaggacctggtgaagtttggtctcatcccagaattcattgggcgtctgccagtcgttgccaccgtatccaacctggatcagaaatctctggtcaaggttctcacggagcctcgtaactcattggtgaagcagtatcgacgtctgtttgaaatggatgacgctgtgttgacctttactgatgatgctttggaggagatcgctaatcaggcactcgagcgcaaaactggcgcccgtggcctgcgcgcgatcatggaagagatcctggttccgatcatgtatgacctcccagaccgtaaagacgttggcgaagtcatcatcaacggtgccgttgcccgtggcgaagccgaaccagagatgttggaagctgtcgcagaagaaaagaccgcgtagttggcaggagttatcaccgg

SEQ ID NO: 70 - protein, 426 aa, Corynebacterium glutamicum
MARMQESADLLKCSFCGKSQKQVKKLIAGGAVYICDECIELCNEIIEEELGQAQHDEQERNELPKPSEISAFLDTYVIGQDPAKRILSVAVYNHYKRLRASETIGRRRNDEPETELVKSNILMLGPTGSGKTFLAQTLAKLLDVPFAIADATSLTEAGYVGEDVENILLKLLQAADFDVERAQRGIIYIDEVDKISRKSENPSITRDVSGEGVQQALLKILEGTVAAIPPQGGRKHPNQDFIQLDTTNILFIVAGAFSGLEKVIADRNGKKGLGFGVEVSSKKEEANIVDIFKDVLPEDLVKFGLIPEFIGRLPVVATVSNLDQKSLVKVLTEPRNSLVKQYRRLFEMDDAVLTFTDDALEEIANQALERKTGARGLRAIMEEILVPIMYDLPDRKDVGEVIINGAVARGEAEPEMLEAVAEEKTA

SEQ ID NO: 71 - DNA, 1401 bp, Corynebacterium glutamicum; identical to SEQ ID NO: 69
  CDS (101)..(1378): FRXA01120

SEQ ID NO: 72 - protein, 426 aa, Corynebacterium glutamicum; identical to SEQ ID NO: 70

SEQ ID NO: 73 - DNA, 1065 bp, Corynebacterium glutamicum
  CDS (101)..(1042): RXA00744
tctgagtcggtagaagtattacccagtgacttaagtttcttagatttttttgagcaacagcgaccagccacgttagtgtggtcgagtagaggatagctacatggggaactgggcagagattactgatgaaatttctaagatttaccaagataatcagtacaagattagacaaataaatgatgttgacgcagtaagcgataaacgtagagaagcgctacaagcactgtttgaacatactggtcgaaatgtaatcgtctattattcagcgtggttagaaaatggtcgacgattttccgggcaatctacggatttttcggtaaatgatactgataaaaacagttttatgactgcgctccataagttggatcagagtaaaggtctcgatcttatcctccacactccgggtggagatgttgctgcgacagagtcgttagtagattacattcacgcactctttggtcaagatttcagagtcattgtcccccaactcgcaatgtcagcaggaacaatgatcgcactttcgtccaaagagattgttatggggaagcattctagtcttggccccattgatcctcagtttaacggcctaccggcacacgggttattggaagaatttgagcaagcgaagaaagaggtctctgagaatccgcagactgctcatatatggcaggtgatcttgaataaatacaaccccacgatgttgggtgaagctaaaaaagctattcagtggtccaactcgatggttaagcagtggcttgaaaagggtatgtttttagacgagcctgacaaagaagaaaaagccactcgcgctatcaaagagctcgctgatcattccgttactcttgcgcataatcgacacatttcggtcagtaaagcacttgagctgggattgaatatcaaagaacttgagagcgatccaaagcttcaagatttagttcttactcttcaccacctgtccgttattgctgcgcaacgaggaccattaattaagtttgtcgtcaatcatgacaaccgtggcacttttctgcaggggcatgaaaactaattaagtgatgcaatagtcta

SEQ ID NO: 74 - protein, 314 aa, Corynebacterium glutamicum
MGNWAEITDEISKIYQDNQYKIRQINDVDAVSDKRREALQALFEHTGRNVIVYYSAWLENGRRFSGQSTDFSVNDTDKNSFMTALHKLDQSKGLDLILHTPGGDVAATESLVDYIHALFGQDFRVIVPQLAMSAGTMIALSSKEIVMGKHSSLGPIDPQFNGLPAHGLLEEFEQAKKEVSENPQTAHIWQVILNKYNPTMLGEAKKAIQWSNSMVKQWLEKGMFLDEPDKEEKATRAIKELADHSVTLAHNRHISVSKALELGLNIKELESDPKLQDLVLTLHHLSVIAAQRGPLIKFVVNHDNRGTFLQGHEN

SEQ ID NO: 75 - DNA, 957 bp, Corynebacterium glutamicum
  CDS (101)..(934): RXA00844
ggtgacggccaaaggcgcgcgcattgcgcgccccaaaatcgacgtcattgacagcatcttgtgacaacattttgtagagcaaccatctagactgttctttatgtcttctgcgtcatttaccaccaaagcactgtccgtactcgcagctttaacggctgcgtctgcccccttagtggcggcgtcacctgcacatgctttggcaaatgctcgcaacgttacgggttcaagcaccacttcagattcaattgttcgtctgcacatcggtaacactgcatgtacaggaaccatgatcaccccaacgtgggcgatcaccgcccgccactgtatccctgagggcggtattgccggtgcagctattggttcaagcactttgagccaatttcagcaggtgtcccaagcgatcttgcaccctactgcggacttagctctcgttgagcttcccaatcaggcaagttccaacacggttgatctctacggtgcacacgtgcagcctggtgaaaatggtcaagcagccggctggggtgggtactctgcctttggccaaaatgttgcacagcaagccgatgtgcaaattcaacgcagggtagtcaatgtgccaagccccgaccgcaccgctgtgctgcttgaaggcactgtttctaacggtcgtctcgtaccaggcgattccggcggacctttgtacatcaatggtcaactggctggtgtgctcagcatgtccactgacgtagaaaacgatgcactagacggcaccgtcggctggtacatccccgttgctgaacacgccgagtggatcgcctactacaccggcaagcacattgcccccattgctggtgcgcccgcagaacttgttgacgccaccgccaaccccaccttcatccctgctccacagcctttcaccggttcatccatcggtggttgggcgctgggcagctcctagaatatgctgatctccctgct

SEQ ID NO: 76 - protein, 278 aa, Corynebacterium glutamicum
MSSASFTTKALSVLAALTAASAPLVAASPAHALANARNVTGSSTTSDSIVRLHIGNTACTGTMITPTWAITARHCIPEGGIAGAAIGSSTLSQFQQVSQAILHPTADLALVELPNQASSNTVDLYGAHVQPGENGQAAGWGGYSAFGQNVAQQADVQIQRRVVNVPSPDRTAVLLEGTVSNGRLVPGDSGGPLYINGQLAGVLSMSTDVENDALDGTVGWYIPVAEHAEWIAYYTGKHIAPIAGAPAELVDATANPTFIPAPQPFTGSSIGGWALGSS

SEQ ID NO: 77 - DNA, 958 bp, Corynebacterium glutamicum
  CDS (101)..(958): RXA01151
ccaggcgtttggctgatggcgtggagcctcctcgtccgcagcgtaaggcacgtcgataaaaagacctagttggagggcgtaaagggttagagtggtgaccatgagttcaccaactgattcttcgccctctaattcttttagcgacttcaaccgggaggaacagtcccggttatctgatgaggtgcgccagctcaagcgcaccaactctgatcttggggcacgtaatgccaagctcgcggagatgctgaagtcgtctcgggataaattgtctgtgctgttttctcagttggaggatatggctcagccgccatcggtgtatggcactttcttggaaaccgcgaaagacggttctaatgcggagatctttgctggtggacgtcgcatgcgtgtggctgtttctcctatgctgtgtgccgcggatttgatgccgggtgtgcaggttcgtttgggtgaaggcaatcaagttcttgaggcctgtgattttgaacaaaccggtgaattagccacgttgatggaaatgattggccgggatcgtgctttggtttcagatcgctcgggggaggagcgcgtcgtcaagcttgctggtccgttgatggatcgcaccgcaaagctgccgcgccccggtgacaccctgcttgttgaccgcaaagcgggctacgcttttgaggcgattgccaagacggaaatttcgaggcttgcgctggaagaggcgccagatgtgtcttatcaggatattggtggcttggatgatcagattgaattgattcaagatgccgttgagctgccatttttgcacccggagatgtaccgcgcctacaacctgcatccaccaaagggcgtgctgctgtacggccctcccggctgtggaaagacgctgattgctaaggctgtggctaattctttggccaaccgcatcggtgagactggcacctcgtacttcatcaacgtcaaggggcca

SEQ ID NO: 78 - protein, 286 aa, Corynebacterium glutamicum
MSSPTDSSPSNSFSDFNREEQSRLSDEVRQLKRTNSDLGARNAKLAEMLKSSRDKLSVLFSQLEDMAQPPSVYGTFLETAKDGSNAEIFAGGRRMRVAVSPMLCAADLMPGVQVRLGEGNQVLEACDFEQTGELATLMEMIGRDRALVSDRSGEERVVKLAGPLMDRTAKLPRPGDTLLVDRKAGYAFEAIAKTEISRLALEEAPDVSYQDIGGLDDQIELIQDAVELPFLHPEMYRAYNLHPPKGVLLYGPPGCGKTLIAKAVANSLANRIGETGTSYFINVKGP

SEQ ID NO: 79 - DNA, 735 bp, Corynebacterium glutamicum
  CDS (101)..(712): RXA02317
gaattttccggtgttaaaatgtgcggtgagcttggcgttggcggaggaccagtgtggggagacgtcgaaaagcgaattcatggccccatcttgccttaaaatggcgcacatgcgcttactgctgacctcctttggccatgatcatattcgggattttgtacgcggtaccgtggcgtatatccctgatgcgaccaggctttttgctgatagtcccgaggctgctccttttatggagacggagcgaaatatgctgcgcgagcacggcttgagcattcgtgagctgccgatttccacgtcgactccggaggaagtggatcgggtgcttggtgaggttgatggggtgtatgtggcgggcggtgagacttttgatctgatgtggctgctgcgttccacaggcaatgatgaggtgttgattaagcatgttcgcgctggtctaccgtatattggaacgagcgccggcgcggtaattgcaggtccttcgattgaaccgatcagctttttggatagccccgatgtcgcgccgaatttaagcgactattcaggtctaggcctgtgcgagcatgtcgtggtgccccatgctggtggcacgatcccgcaatttcccatcgatgtgtttgcggaaaccgtgcgcacctacggcgccgaattcccgctggtcctgcttaaagatggacaggcactgcttatcgacgaccacggcgtccacctaatttaggatggttccccatgagcacc

SEQ ID NO: 80 - protein, 204 aa, Corynebacterium glutamicum
MAHMRLLLTSFGHDHIRDFVRGTVAYIPDATRLFADSPEAAPFMETERNMLREHGLSIRELPISTSTPEEVDRVLGEVDGVYVAGGETFDLMWLLRSTGNDEVLIKHVRAGLPYIGTSAGAVIAGPSIEPISFLDSPDVAPNLSDYSGLGLCEHVVVPHAGGTIPQFPIDVFAETVRTYGAEFPLVLLKDGQALLIDDHGVHLI

SEQ ID NO: 81 - DNA, 774 bp, Corynebacterium glutamicum
  CDS (101)..(751): RXA02644
cgtggggaagtggagcccacactgaaaagctttgcgaggtcaacatggccaccaggctagtgaaaatgctgccggttggcgagctaagatgtgagatgctatggcacatctcacgcaataccaactccctcaggccggtcaagtctttgagcatgaactagagatcaagcgctcgcgatttctgacctatatcacgcgtgtgcaagatcaggagcaggctcgcgaatttattcactccatcaaggagctgtatccggatgcgcgtcatcattgcagtgcctttattttccatgtggatggctcaaatgatgtggagcgttcctctgatgatggcgaaccttccggtaccgcgggaaaacccatgctagaggcgttgcgtggctcgggaatgaaagatattgccgctgtggtggtgcgttatttcggtggcgtaaaactgggcactggcggattagttaatgcctacaccaacgcggtgacggagcttctacctgaggttttgcaagtcacccgctctgttcgggagattttcaagattgaccttccgcattctgatgcggggcgcattgaagcgaatctgcgcggcatgggcatcatcattactgacactgaatatggtgcagaagtcacatacaccttggctttattgcctggtgaacaggctgcggtggaatctcaattgtcatccatgatgggtgcagaaattgaattgaaagaatccgggcacatgtgggtggaatccccgagtgactagtgcggtgtaagagcactaga

SEQ ID NO: 82 - protein, 217 aa, Corynebacterium glutamicum
MAHLTQYQLPQAGQVFEHELEIKRSRFLTYITRVQDQEQAREFIHSIKELYPDARHHCSAFIFHVDGSNDVERSSDDGEPSGTAGKPMLEALRGSGMKDIAAVVVRYFGGVKLGTGGLVNAYTNAVTELLPEVLQVTRSVREIFKIDLPHSDAGRIEANLRGMGIIITDTEYGAEVTYTLALLPGEQAAVESQLSSMMGAEIELKESGHMWVESPSD

SEQ ID NO: 83 - DNA, 1411 bp, Corynebacterium glutamicum
  CDS (101)..(1411): RXN02820
caacgaaacaaatgcaagcccccaatcatgggtttctaccaattaaattttctttcagaaaatatctccccacataaaagttccttgataggctcgagagatgaaagtgacccaaagcacattccttaaatcggtagctgcgttcactgtcgcagccttaaccctgaccatctcttcgtgttccagcggtgaagacacctccgcaagctccacggatactgaaaactcctcaacccaagcagcagcgtctcccccacttgcgccttgtgaacttcccgccgacgcttctgctgaagaggaagtagaaggcactcacacaggtgaagatatttctgttgccccggaaatcggtaccggctaccgcgagggcatgacccctgttcaaacccaaggttatgcggtggcaactgcaaaccccatcgcttctgaagcagcctgcgcggtgttaagagaaggcggcactgcagctgatgctcttgtcaccgcgcagtttgttttgggactgacggaaccgcagtcgtctggccttggtggtggcggatacattctgtactacgacgccgaagccaatgcggtgacagccattgatggccgtgaaacagcgccagttgctgctgatgaaaactatctcattcatgtttctgcagaggatcaaacggcacctgttcctgatgcccgacgttccggcaggtcaattggtgtgccaggaatcgtggcagcccttggacagctgcatgattcattcggaaagacctcctggcaggacgtgctgacaactccgcagcagctcgcaactgatggtttttccatcagccctcgcatgtcagcatcaattgctaactccgctgaggatctctcccacgatccggaagctgccgcatatttccttgatgaaaacggtgatgcgaaggcacccggcacacttttacaaaaccctgactatgcagaaacgattcgtctcatctctgaaggtggccccgatgcgttctacacgggtgagattgcagcagacatcgtggaacgcgccacccgtgaggttgacggtttcacaccatcactgatgagcacggcagatttggctgcctacactccggaaactcgtgaagctttgtgtgctccctaccgcgacaagattgtttgtggcatgccaccgtcatcatcgggtggcgtcacagtgatggaaaccctgggtatcttgaacaactttgatctcgcccaatacccacccactgaggttggtttggatggcggattgccaaatgcggaagctgttcacctgatttcagaggctgagcgcctggcttatgctgatcgcgatgcttacatcggtgatcctgctttcgtggaagttccagcaggtggtgtccaacagtggatcaaccatgtccacacgggcgaacactccaaactt

SEQ ID NO: 84 - protein, 437 aa, Corynebacterium glutamicum
MKVTQSTFLKSVAAFTVAALTLTISSCSSGEDTSASSTDTENSSTQAAASPPLAPCELPADASAEEEVEGTHTGEDISVAPEIGTGYREGMTPVQTQGYAVATANPIASEAACAVLREGGTAADALVTAQFVLGLTEPQSSGLGGGGYILYYDAEANAVTAIDGRETAPVAADENYLIHVSAEDQTAPVPDARRSGRSIGVPGIVAALGQLHDSFGKTSWQDVLTTPQQLATDGFSISPRMSASIANSAEDLSHDPEAAAYFLDENGDAKAPGTLLQNPDYAETIRLISEGGPDAFYTGEIAADIVERATREVDGFTPSLMSTADLAAYTPETREALCAPYRDKIVCGMPPSSSGGVTVMETLGILNNFDLAQYPPTEVGLDGGLPNAEAVHLISEAERLAYADRDAYIGDPAFVEVPAGGVQQWINHVHTGEHSKL

SEQ ID NO: 85 - DNA, 507 bp, Corynebacterium glutamicum
  CDS (1)..(507): FRXA02820
gctaactccgctgaggatctctcccacgatccggaagctgccgcatatttccttgatgaaaacggtgatgcgaaggcacccggcacacttttacaaaaccctgactatgcagaaacgattcgtctcatctctgaaggtggccccgatgcgttctacacgggtgagattgcagcagacatcgtggaacgcgccacccgtgaggttgacggtttcacaccatcactgatgagcacggcagatttggctgcctacactccggaaactcgtgaagctttgtgtgctccctaccgcgacaagattgtttgtggcatgccaccgtcatcatcgggtggcgtcacagtgatggaaaccctgggtatcttgaacaactttgatctcgcccaatacccacccactgaggttggtttggatggcggattgccaaatgcggaagctgttcacctgatttcagaggctgagcgcctggcttatgctgatcgcgatgcttacatcggtgatcctgctttc

SEQ ID NO: 86 - protein, 169 aa, Corynebacterium glutamicum
ANSAEDLSHDPEAAAYFLDENGDAKAPGTLLQNPDYAETIRLISEGGPDAFYTGEIAADIVERATREVDGFTPSLMSTADLAAYTPETREALCAPYRDKIVCGMPPSSSGGVTVMETLGILNNFDLAQYPPTEVGLDGGLPNAEAVHLISEAERLAYADRDAYIGDPAF

SEQ ID NO: 87 - DNA, 604 bp, Corynebacterium glutamicum
  CDS (101)..(604): FRXA02000
caacgaaacaaatgcaagcccccaatcatgggtttctaccaattaaattttctttcagaaaatatctccccacataaaagttccttgataggctcgagagatgaaagtgacccaaagcacattccttaaatcggtagctgcgttcactgtcgcagccttaaccctgaccatctcttcgtgttccagcggtgaagacacctccgcaagctccacggatactgaaaactcctcaacccaagcagcagcgtctcccccacttgcgccttgtgaacttcccgccgacgcttctgctgaagaggaagtagaaggcactcacacaggtgaagatatttctgttgccccggaaatcggtaccggctaccgcgagggcatgacccctgttcaaacccaaggttatgcggtggcaactgcaaaccccatcgcttctgaagcagcctgcgcggtgttaagagaaggcggcactgcagctgatgctcttgtcaccgcgcagtttgttttgggactgacggaaccgcagtcgtctggccttggtggtggcggatacattctgtactacgacgccgaagccaatgcggtgacagccattgatggccgtgaaacagcg

SEQ ID NO: 88 - protein, 168 aa, Corynebacterium glutamicum
MKVTQSTFLKSVAAFTVAALTLTISSCSSGEDTSASSTDTENSSTQAAASPPLAPCELPADASAEEEVEGTHTGEDISVAPEIGTGYREGMTPVQTQGYAVATANPIASEAACAVLREGGTAADALVTAQFVLGLTEPQSSGLGGGGYILYYDAEANAVTAIDGRETA

SEQ ID NO: 89 - DNA, 824 bp, Corynebacterium glutamicum
  CDS (1)..(801): RXN03178
cccaccaccgtggtcacgggcacgatggaagccgccaacatcgagggctcccgcgtgggtgtcggcgaggccggccagtataccgttgatcagctgctgcacggtcttcttttagccagcggtaacgatgcggcgtatatgttggctcaggaacttggtggggatcaagcaaccctggagaaagtaaacgcgctggccaaggagttgggcactcaagacaccttcgttgccacttattccggtttggatgcgccgggaatgtcgacctccgcatacgacatgtcattgatttatcagcatgcgtggcagaacccggttttcgagtcgattatctccaccgatcacattgatttccctggttggggcgacaatgagggtttccaagtctggaacgataacgccttgttcatgaacgatcctgatggcatcggcggcaagaccggctacaccgacgacgcgaaccacacctttgtcggcggtctcgatcggggtggtcgccgcctcgccgccgtactcttggattccaccgtcagcgacattcgtccgtgggaacaagcacgattgcttatcgacgcctccctccccatcacgccggggtccggcgtgggccagctgggctccggcagcgcgaacgatgtggcaccggcgaccccagaattaccagaacccaccgacaacctgacttcaggtgagggtgggtcgcagaacacgcttcttaagctcgtggtgcccatcggaatcatcgtgctgttgctaatcgccgcactagcgtggacattcagatctcccaagaaaaagaactaggtgttcttcttcacgacctc

SEQ ID NO: 90 - protein, 267 aa, Corynebacterium glutamicum
PTTVVTGTMEAANIEGSRVGVGEAGQYTVDQLLHGLLLASGNDAAYMLAQELGGDQATLEKVNALAKELGTQDTFVATYSGLDAPGMSTSAYDMSLIYQHAWQNPVFESIISTDHIDFPGWGDNEGFQVWNDNALFMNDPDGIGGKTGYTDDANHTFVGGLDRGGRRLAAVLLDSTVSDIRPWEQARLLIDASLPITPGSGVGQLGSGSANDVAPATPELPEPTDNLTSGEGGSQNTLLKLVVPIGIIVLLLIAALAWTFRSPKKKN

SEQ ID NO: 91 - DNA, 749 bp, Corynebacterium glutamicum
  CDS (1)..(726): FRXA02859
cagtataccgttgatcagctgctgcacggtcttcttttagccagcggtaacgatgcggcgtatctgttggctcaggaacttggtggggatcaagcaaccctggagaaagtaaacgcgctggccaaggagttgggcactcaagacaccttcgttgccacttattccggtttggatgcgccgggaatgtcgacctccgcatacgacatgtcattgatttatcagcatgcgtggcagaacccggttttcgagtcgattatctccaccgatcacattgatttccctggttggggcgacaatgagggtttccaagtctggaacgataacgccttgttcatgaacgatcctgatggcatcggcggcaagaccggctacaccgacgacgcgaaccacacctttgtcggcggtctcgatcggggtggtcgccgcctcgccgccgtactcttggattccaccgtcagcgacattcgtccgtgggaacaagcacgattgcttatcgacgcctccctccccatcacgccggggtccggcgtgggccagctgggctccggcagcgcgaacgatgtggcaccggcgaccccagaattaccagaacccaccgacaacctgacttcaggtgagggtgggtcgcagaacacgctgcttaagctcgtggtgcccatcggaatcatcgtgctgttgctaatcgccgcactagcgtggacattcagatctcccaagaaaaagaactaggtgttcttcttcacgacctc

SEQ ID NO: 92 - protein, 242 aa, Corynebacterium glutamicum
QYTVDQLLHGLLLASGNDAAYLLAQELGGDQATLEKVNALAKELGTQDTFVATYSGLDAPGMSTSAYDMSLIYQHAWQNPVFESIISTDHIDFPGWGDNEGFQVWNDNALFMNDPDGIGGKTGYTDDANHTFVGGLDRGGRRLAAVLLDSTVSDIRPWEQARLLIDASLPITPGSGVGQLGSGSANDVAPATPELPEPTDNLTSGEGGSQNTLLKLVVPIGIIVLLLIAALAWTFRSPKKKN

SEQ ID NO: 93 - DNA, 1212 bp, Corynebacterium glutamicum
  CDS (101)..(1189): RXA00137
tttacagagtgcttatgaggcaatcagccactaagtgttgagtaatctactagtttggactagaagttacccactttcagtgaatttttaaggagagaacatggctttggctgatacccgatttgccactcgtcgtcgcgcacttgccgcaaaactggcagctcaacggatcgactcaattttggtgacaagcccgatccatgttcgctatctcagcggattcaccggctccaacggcgcactgatcgtgaacaaagatctctccgcgcagatctgcaccgacggtcgctacaccacccagatcgcagaagaagtcccggacatcgaggcgctgattgagcgtgcctcggcaacgacgctgctagcgcaggtcgaagggccgcgtcgtatagcaatcgaagccgcacaaaccaccctggaccagctagacagcctgcgtgaagcaacccaggaagacgtcgagctgatccccgtgtcaggtgttgtggaatccattcgcctgaccaaagacagcttcgaactcgaccgcctccgcgatgtcgcagcgctggcttcccaagcattcgaagatttactcgcagcaggagaactcgccgaaggccgatcagagcgccaagtcgccgccgatctggaataccgcatgcgcctgttgggagcagaacgccccagcttcgacaccatcgtggcctctggacctaactccgcgaaaccacaccacggcgcaggcgaccgcatcctccagcgcggcgatctagtcaccatcgatttcggcgcacacgcacgcggattcaactccgatatgacccgcaccctcgttatgggcgaagcaggggagttcgaagcagaaatctacgacatcgtcctgcgctcccaactcgctggtgttgaagcagcctactcaggcgccaacctcttcgacatcgacgcagcatgccgcaaaatcatcgaagacgcaggctacggcgaatacttcgtgcactccaccggccacggcatcggacttgaagtccacgaagccccaagcgcatccaaaacctcacaaggagtcctagaaaccggctccacactgaccatcgaacccggaatttacgtccccggaaagggcggcgtacgcatcgaagacaccctgattattacctcaggagcaccggaaatcatcaccaaggtgagtaaggacctcatcgtggtgtaatctaggtgagctaatcggtc

SEQ ID NO: 94 - protein, 363 aa, Corynebacterium glutamicum
MALADTRFATRRRALAAKLAAQRIDSILVTSPIHVRYLSGFTGSNGALIVNKDLSAQICTDGRYTTQIAEEVPDIEALIERASATTLLAQVEGPRRIAIEAAQTTLDQLDSLREATQEDVELIPVSGVVESIRLTKDSFELDRLRDVAALASQAFEDLLAAGELAEGRSERQVAADLEYRMRLLGAERPSFDTIVASGPNSAKPHHGAGDRILQRGDLVTIDFGAHARGFNSDMTRTLVMGEAGEFEAEIYDIVLRSQLAGVEAAYSGANLFDIDAACRKIIEDAGYGEYFVHSTGHGIGLEVHEAPSASKTSQGVLETGSTLTIEPGIYVPGKGGVRIEDTLIITSGAPEIITKVSKDLIVV

SEQ ID NO: 95 - DNA, 1404 bp, Corynebacterium glutamicum
  CDS (101)..(1381): RXN00499
tgccaacaggggatatgccactgtgtaccccacggcgatgatcggtaaaatcctcggcgcgcagatattgttcttgctgctctaaggtgatttttgggcagtggtgggggtggtgtccacccctgcgcgtaacctgggaagcatgactaaaacacttggttcccttcagctggaagaaatcacgctgaccctccctctgactgaagatgtggccgatgaacgcaccattgatgtgttcgcacgcattgccacacgcgtcggtggggaagaccttccatatttagtattcctgcagggtgggcctggcaatgaagctccacgtccaagccttaatcccctcaaccccaattggttgggcgtggccttggaggaataccgcgtggtcatgttggatcaacgtggcaccggccgttccaccccagtgggtaatgatattttggaaaaacccacagcagaagtagtggagtacttatcccacctgcgcgcagatggcattgtgcgagatgctgaagccctgcgtaagcatttgggtgtgaatcagtggaaccttttaggccagtccttcggaggtttcaccaccctgcattacttgtcccggcacgccgattccttggacaacgtgtttattaccggcggtctcagcgctattgatcgcccagcagaagacgtgtatgccaactgttacaaccgcatgcgccgaaactctgaggaattctaccgtcgcttcccgcaattacgggaaactttccgagggttggttaatcgtgctcgcgccggggagattgtgcttcccaccggcgaagttgtgtcagaaaccaggctgcgatcccttggtcacttgttgggtagcaatgacggctggtttgatctgtacaacctgctggaattagatcccacctccaacgcttttgtccatgacctggcaggacttttgcctttcggcaaccgcaacccaatttattacgtgctccatgagtcctcttacgccgacggtgtggtgacaaattgggcagcagagcgtgtgcttccagaggatttccgcgaggatccaacactgctcaccggtgagcacgtgttccaggagtggacagacaccgtgccgtcgctcaagccgtggaaggacgttgccctggcattggctcagcaggaatggcccaagctttatgatgcgaaggcattggaaaactcacaggccaagggcgctgcagcagtgtatgccaatgacgttttcgtcccagtggattactctctggaaaccgcacaacacctgcccggtgtgcagctgtttatcaccagccagcatgaacacaatggacttcgtgccagctcaggcgcagtactgaagcaccttttcgatctggcccacggccgagaggtacgctgattcctcgtgttagtactagc

SEQ ID NO: 96 - protein, 427 aa, Corynebacterium glutamicum
VVGVVSTPARNLGSMTKTLGSLQLEEITLTLPLTEDVADERTIDVFARIATRVGGEDLPYLVFLQGGPGNEAPRPSLNPLNPNWLGVALEEYRVVMLDQRGTGRSTPVGNDILEKPTAEVVEYLSHLRADGIVRDAEALRKHLGVNQWNLLGQSFGGFTTLHYLSRHADSLDNVFITGGLSAIDRPAEDVYANCYNRMRRNSEEFYRRFPQLRETFRGLVNRARAGEIVLPTGEVVSETRLRSLGHLLGSNDGWFDLYNLLELDPTSNAFVHDLAGLLPFGNRNPIYYVLHESSYADGVVTNWAAERVLPEDFREDPTLLTGEHVFQEWTDTVPSLKPWKDVALALAQQEWPKLYDAKALENSQAKGAAAVYANDVFVPVDYSLETAQHLPGVQLFITSQHEHNGLRASSGAVLKHLFDLAHGREVR

SEQ ID NO: 97 - DNA, 980 bp, Corynebacterium glutamicum
  CDS (1)..(957): FRXA00499
ggtaatgatattttggaaaaacccacagcagaagtagtggagtacttatcccacctgcgcgcagatggcattgtgcgagatgctgaagccctgcgtaagcatttgggtgtgaatcagtggaaccttttaggccagtccttcggaggtttcaccaccctgcattacttgtcccggcacgccgattccttggacaacgtgtttattaccggcggtctcagcgctattgatcgcccagcagaagacgtgtatgccaactgttacaaccgcatgcgccgaaactctgaggaattctaccgtcgcttcccgcaattacgggaaactttccgagggttggttaatcgtgctcgcgccggggagattgtgcttcccaccggcgaagttgtgtcagaaaccaggctgcgatcccttggtcacttgttgggtagcaatgacggctggtttgatctgtacaacctgctggaattagatcccacctccaacgcttttgtccatgacctggcaggacttttgcctttcggcaaccgcaacccaatttattacgtgctccatgagtcctcttacgccgacggtgtggtgacaaattgggcagcagagcgtgtgcttccagaggatttccgcgaggatccaacactgctcaccggtgagcacgtgttccaggagtggacagacaccgtgccgtcgctcaagccgtggaaggacgttgccctggcattggctcagcaggaatggcccaagctttatgatgcgaaggcattggaaaactcacaggccaagggcgctgcagcagtgtatgccaatgacgttttcgtcccagtggattactctctggaaaccgcacaacacctgcccggtgtgcagctgtttatcaccagccagcatgaacacaatggacttcgtgccagctcaggcgcagtactgaagcaccttttcgatctggcccacggccgagaggtacgctgattcctcgtgttagtactagc

SEQ ID NO: 98 - protein, 319 aa, Corynebacterium glutamicum
GNDILEKPTAEVVEYLSHLRADGIVRDAEALRKHLGVNQWNLLGQSFGGFTTLHYLSRHADSLDNVFITGGLSAIDRPAEDVYANCYNRMRRNSEEFYRRFPQLRETFRGLVNRARAGEIVLPTGEVVSETRLRSLGHLLGSNDGWFDLYNLLELDPTSNAFVHDLAGLLPFGNRNPIYYVLHESSYADGVVTNWAAERVLPEDFREDPTLLTGEHVFQEWTDTVPSLKPWKDVALALAQQEWPKLYDAKALENSQAKGAAAVYANDVFVPVDYSLETAQHLPGVQLFITSQHEHNGLRASSGAVLKHLFDLAHGREVR

SEQ ID NO: 99 - DNA, 1788 bp, Corynebacterium glutamicum
  CDS (101)..(1765): RXN00877
aaataatggggctcgccggtgatggttcccgccgggcattcaacggtgacggaagaggtggcagacatgatgaaaactctagcaactagtatcggtcactatgactgttgaacacctgctcaagcccagcaccttgccctaccagctgcccgatttcgcagcgatcaaggtggctgatttcccgcccgccttcgaactcgcattagctgaacacgatgctgaaattacagcgatcgctaccaatgaggacgctcctacctgggagaacaccattgaggccctggaacgcgcaggcctgtccctcaaccgcgtcgccgccgtattcttcaacttgcagggcaccgattcctcccctgaaatggatgaaatcgcagccactatcgcgccgaaactctccgcgcattcggatgcgattttccacaatgctgcgcttttcgcgcgcattgaggccgtagaagcaccggccgacgaggaatcgcaacgcctgttgtcccacaccaagcgcgcttttcgacgtcgcggtgcagcactcaacgccgacggcaaggcccgactgagcaccatcaaccagcgcctatcggcactgtccgaacagttcggccgcaacctgcttcaggacacccgcgatctggcggtcaactttgaagaatctgaacttgccggttttagcgaagcccgcatatccgccgccgctgactacgcagcagcagttggcaccgaaggctacgtggttccactggaactgcccaccgtgcagtcagagcaggcagtattaaccgaatccgcctcgcgtgcaaagctttatgaagcctcccagaagcgtggcgccagcctgaacaaggacgtgctgctcgaaaccgtgcgtctgcgtgctgaacgcgccacacttttaggctacgacacccacgccgattacgtcatcgaagaagaaaccgccgatgacgtcgcagccgtgcgcgccttgctttatgatctcgccccagccgcctctgccaatgcgaaagccgaatacaaactctccgcagaagaagcagaagaacacggccaaaaagtcggcgcagctgactggagcttctgggaagccaaagtccgcgcccgcgactacgccctggacgaaaccgaactgcgcaactacttcccattgaaccaagtactccgtgacggcgtcttcttcgctgctaaccgcctctacggaatcaccgtggaaccacgccctgacctgcgcggttacgccgagggcgtggacgtctgggaagtcctcgattctgacggctccggcatcggcctgatccttaccgactactacggccgaccatccaagcggggcggcgcttggatgtccagctttgtcgaccaatccgagctgctaggcaccaagccagtcgtggtcaacgttatgggtattaccaaaccaaccaccggcgaagcactactcagcctcgatgaagtaaccaccatcttccacgaattcggccacggcctgcacggcttgctgtccaaggtgcgctacccaagcttctccggaacctccgtgccccgcgactacgtagaattcccctcccagatcaacgaaaactgggcattcgaccctgcagtagtccgcaactacgcccgccacgtggacaccggcgacatcattccagactccctgcttgaggcagtggaagcatgtggcatttcagacagagtggtggaacatgtgagtacttgtccccatctattatcgacctgccctgtctctccctgtccacagcggatgccgcactagtcaatgacattgaccaatta

SEQ ID NO: 100 - protein, 555 aa, Corynebacterium glutamicum
MTVEHLLKPSTLPYQLPDFAAIKVADFPPAFELALAEHDAEITAIATNEDAPTWENTIEALERAGLSLNRVAAVFFNLQGTDSSPEMDEIAATIAPKLSAHSDAIFHNAALFARIEAVEAPADEESQRLLSHTKRAFRRRGAALNADGKARLSTINQRLSALSEQFGRNLLQDTRDLAVNFEESELAGFSEARISAAADYAAAVGTEGYVVPLELPTVQSEQAVLTESASRAKLYEASQKRGASLNKDVLLETVRLRAERATLLGYDTHADYVIEEETADDVAAVRALLYDLAPAASANAKAEYKLSAEEAEEHGQKVGAADWSFWEAKVRARDYALDETELRNYFPLNQVLRDGVFFAANRLYGITVEPRPDLRGYAEGVDVWEVLDSDGSGIGLILTDYYGRPSKRGGAWMSSFVDQSELLGTKPVVVNVMGITKPTTGEALLSLDEVTTIFHEFGHGLHGLLSKVRYPSFSGTSVPRDYVEFPSQINENWAFDPAVVRNYARHVDTGDIIPDSLLEAVEACGISDRVVEHVSTCPHLLSTCPVSPCPQRMPH

SEQ ID NO: 101 - DNA, 1088 bp, Corynebacterium glutamicum
  CDS (1)..(1065): FRXA00877
gcagcagcagttggcaccgaaggctacgtggttccactggaactgcccaccgtgcagtcagagcaggcagtattaaccgaatccgcctcgcgtgcaaagctttatgaagcctcccagaagcgtggcgccagcctgaacaaggacgtgctgctcgaaaccgtgcgtctgcgtgctgaacgcgccacacttttaggctacgacacccacgccgattacgtcatcgaagaagaaaccgccgatgacgtcgcagccgtgcgcgccttgctttatgatctcgccccagccgcctctgccaatgcgaaagccgaatacaaactctccgcagaagaagcagaagaacacggccaaaaagtcggcgcagctgactggagcttctgggaagccaaagtccgcgcccgcgactacgccctggacgaaaccgaactgcgcaactacttcccattgaaccaagtactccgtgacggcgtcttcttcgctgctaaccgcctctacggaatcaccgtggaaccacgccctgacctgcgcggttacgccgagggcgtggacgtctgggaagtcctcgattctgacggctccggcatcggcctgatccttaccgactactacggccgaccatccaagcggggcggcgcttggatgtccagctttgtcgaccaatccgagctgctaggcaccaagccagtcgtggtcaacgttatgggtattaccaaaccaaccaccggcgaagcactactcagcctcgatgaagtaaccaccatcttccacgaattcggccacggcctgcacggcttgctgtccaaggtgcgctacccaagcttctccggaacctccgtgccccgcgactacgtagaattcccctcccagatcaacgaaaactgggcattcgaccctgcagtagtccgcaactacgcccgccacgtggacaccggcgacatcattccagactccctgcttgaggcagtggaagcatgtggcatttcagacagagtggtggaacatgtgagtacttgtccccatctattatcgacctgccctgtctctccctgtccacagcggatgccgcactagtcaatgacattgaccaatta

SEQ ID NO: 102 - protein, 355 aa, Corynebacterium glutamicum
AAAVGTEGYVVPLELPTVQSEQAVLTESASRAKLYEASQKRGASLNKDVLLETVRLRAERATLLGYDTHADYVIEEETADDVAAVRALLYDLAPAASANAKAEYKLSAEEAEEHGQKVGAADWSFWEAKVRARDYALDETELRNYFPLNQVLRDGVFFAANRLYGITVEPRPDLRGYAEGVDVWEVLDSDGSGIGLILTDYYGRPSKRGGAWMSSFVDQSELLGTKPVVVNVMGITKPTTGEALLSLDEVTTIFHEFGHGLHGLLSKVRYPSFSGTSVPRDYVEFPSQINENWAFDPAVVRNYARHVDTGDIIPDSLLEAVEACGISDRVVEHVSTCPHLLSTCPVSPCPQRMPH

SEQ ID NO: 103 - DNA, 2724 bp, Corynebacterium glutamicum
  CDS (101)..(2701): RXN01014
tcttaaagttttctagcaatccacactaggcgcgaactatcgtggtgtcattgcgcaccttctaagggtagcgccccctcaaatttcaaggagcattaaattgacgtccactaatctcacccgacaggaagcttcggatcgttcgaggttactgagtgtagaaaactatgacattgcacttgatctcaacaacggtgatgagttttttagttcctccaccgttgtcagcttcactgtcaggaaggctggcgatacctttattgatctccgcgcagcaagcgttgaggaggttcgcctggacaatgtgtccatcaaagatgaggctctaacccttggcaagaacggctacgacgagacgttcggcatcgccctgaagggtcttactcccggcgcgcacaccttgcgggtaacggcgtctatcccctattcccgcaccggtgaaggcctgcaccgcatggtggatccagcagacaatgaggtgtatttgtacacccagtttgagaccgccgatgccaagcgtatgttcgcgtgtttcgatcagccagacctcaaggctacctatgatctgaacatcaaaactcctaagggttggaagatcatttccaactctgagcagcaggtttccactcagcacactgattacgatacccacatttcccgagtggactatcccctctccacctacctgattgcggtgtgcgcgggtcgttaccacgaggtgtgcgatgtctggaagggtacgctcacccaccatgcagaaacacctgccgatcagccaactgagctgactgttccgcttgctctctactgccgcagttctttggctaaagatcttgatgcggtgcgtctgtttaccgaaacgaagcagggctttgattggtaccaccgcaacttcggtgtggcgtacccattcggcaagtacgatcagatcttcgtccctgaatttaatgctggcgcgatggagaacgccggcgctgtcaccatccgcgatgagtacgtttttgcatccaaggcaacccgttaccgctacgagcgccgcgctgaaaccatccttcacgagctcgctcacatgtggttcggtgtgctggtgaccatgcagtggtgggatgatctgtggctcaacgagtccttcgccacttggtccgcggcaatttctcaggctgaggaaactgaatacaacactgcatgggtgactttcgccaatgtggagaagtcgtgggcgtaccagcaggatcagctgccttccacccacccggtgttctctgacggatacgacattgagactgtcgaccagaacttcgacggcatcacctacgcaaagggcgcctcggtgctcaagcagctgcaggcatacgttggccgtgaggaattcctggcaggcgtacgcaggcactttgccaaccacgcatggggcaacgccagctttgatgatctgctcggcgccctcgagcagtcctccggccgcgacctctccgactgggcaaaccagtggctcaagaccaccggcatcaacaccctcggcgcaaagttcaccaccgacaacggcaaatacacctccttctccgtcacccagaccggcgccgcgccgggtgccggtgagctgcggactcaccgcatcgcggtgggtctttataagcttgtcgacggatccctcaaccgctacgcacgagtagaacttgactgcagtggcgcgtcgacaagcgttgaagagatcgttggacttgagcaggctgacttcgtgctggtcaacgatgatgatctgacgtatgcgctgctggatctggatgatgattcacgcaattttgtcatcgacaatattgataagttcagcgaccctatgcctcgcacgctggtgtggtccgctgcgtgggagatgactcgcgctggtcagatgaaggctcgtgatttcatcgcgctggttgctcgtggcgctgctgcggaaactgaaattgctgtgctggagcgcattctcgcgcaggctacctctgcgctgaagagctacgccgacccagcgtgggcagaagcaactggaaatgacctgctggccgatgctttccttgagggtgctcgctccgcagaaccagactccgacactcagttggcgttcattcaggctctggcaaaagcaacgctcaatgatgctgctgccgattacttccgcgacattcttgccggcaacgtcgaaggcctgaccgtggatcctgacctgcgttggtgggcactgactgcgcttatcgcccgtggtgacatcgaggctgtcgaagatgcaatcgccgctgaactttcccgcgacaactccagtgcctccttcctcgcatcacttcgagccggtgccgctgtgaacactgaagaagtgaaggctgctgcatacaagcatgtcacggcagttgatagtggcctatccaacctggagctgcgccacaagattgaaggcctcacattcactggctcttctgaactgctgcaagcctacaacgagcagtacttcgaaatccttgatgatgtgtgggcgaacttctccggcgaaatggcacagcagatcgtcctcggactgttcccttcatggaacgtttccgaagagggtctcaagcgtaccgacgagtttcttgatggcgaacatgtcgcaggcatcaagcgaattgtttccgaatccctcgaccgcactgcccgtgctctgcgcaaccgtgcggcagatgctgcgtaagtaaaagattctcaatccca

SEQ ID NO: 104 - protein, 867 aa, Corynebacterium glutamicum
LTSTNLTRQEASDRSRLLSVENYDIALDLNNGDEFFSSSTVVSFTVRKAGDTFIDLRAASVEEVRLDNVSIKDEALTLGKNGYDETFGIALKGLTPGAHTLRVTASIPYSRTGEGLHRMVDPADNEVYLYTQFETADAKRMFACFDQPDLKATYDLNIKTPKGWKIISNSEQQVSTQHTDYDTHISRVDYPLSTYLIAVCAGRYHEVCDVWKGTLTHHAETPADQPTELTVPLALYCRSSLAKDLDAVRLFTETKQGFDWYHRNFGVAYPFGKYDQIFVPEFNAGAMENAGAVTIRDEYVFASKATRYRYERRAETILHELAHMWFGVLVTMQWWDDLWLNESFATWSAAISQAEETEYNTAWVTFANVEKSWAYQQDQLPSTHPVFSDGYDIETVDQNFDGITYAKGASVLKQLQAYVGREEFLAGVRRHFANHAWGNASFDDLLGALEQSSGRDLSDWANQWLKTTGINTLGAKFTTDNGKYTSFSVTQTGAAPGAGELRTHRIAVGLYKLVDGSLNRYARVELDCSGASTSVEEIVGLEQADFVLVNDDDLTYALLDLDDDSRNFVIDNIDKFSDPMPRTLVWSAAWEMTRAGQMKARDFIALVARGAAAETEIAVLERILAQATSALKSYADPAWAEATGNDLLADAFLEGARSAEPDSDTQLAFIQALAKATLNDAAADYFRDILAGNVEGLTVDPDLRWWALTALIARGDIEAVEDAIAAELSRDNSSASFLASLRAGAAVNTEEVKAAAYKHVTAVDSGLSNLELRHKIEGLTFTGSSELLQAYNEQYFEILDDVWANFSGEMAQQIVLGLFPSWNVSEEGLKRTDEFLDGEHVAGIKRIVSESLDRTARALRNRAADAA

SEQ ID NO: 105 - DNA, 1578 bp, Corynebacterium glutamicum
  CDS (1)..(1578): FRXA01014
gatgatctgtggctcaacgagtccttcgccacttggtccgcggcaatttctcaggctgaggaaactgaatacaacactgcatgggtgactttcgccaatgtggagaagtcgtgggcgtaccagcaggatcagctgccttccacccacccggtgttctctgacggatacgacattgagactgtcgaccagaacttcgacggcatcacctacgcaaagggcgcctcggtgctcaagcagctgcaggcatacgttggccgtgaggaattcctggcaggcgtacgcaggcactttgccaaccacgcatggggcaacgccagctttgatgatctgctcggcgccctcgagcagtcctccggccgcgacctctccgactgggcaaaccagtggctcaagaccaccggcatcaacaccctcggcgcaaagttcaccaccgacaacggcaaatacacctccttctccgtcacccagaccggcgccgcgccgggtgccggtgagctgcggactcaccgcatcgcggtgggtctttataagcttgtcgacggatccctcaaccgctacgcacgagtagaacttgactgcagtggcgcgtcgacaagcgttgaagagatcgttggacttgagcaggctgacttcgtgctggtcaacgatgatgatctgacgtatgcgctgctggatctggatgatgattcacgcaattttgtcatcgacaatattgataagttcagcgaccctatgcctcgcacgctggtgtggtccgctgcgtgggagatgactcgcgctggtcagatgaaggctcgtgatttcatcgcgctggttgctcgtggcgctgctgcggaaactgaaattgctgtgctggagcgcattctcgcgcaggctacctctgcgctgaagagctacgccgacccagcgtgggcagaagcaactggaaatgacctgctggccgatgctttccttgagggtgctcgctccgcagaaccagactccgacactcagttggcgttcattcaggctctggcaaaagcaacgctcaatgatgctgctgccgattacttccgcgacattcttgccggcaacgtcgaaggcctgaccgtggatcctgacctgcgttggtgggcactgactgcgcttatcgcccgtggtgacatcgaggctgtcgaagatgcaatcgccgctgaactttcccgcgacaactccagtgcctccttcctcgcatcacttcgagccggtgccgctgtgaacactgaagaagtgaaggctgctgcatacaagcatgtcccggcagttgatagtggcctatccaacctggagctgcgccacaagattgaaggcctcacattcactggctcttttgaactgctgcaagcctacaacgagcagtacttcgaaatccttgatgatgtgtgggcgaacttctccggcgaaatggcacagcagatcgtcctcggactgttcccttcatggaacgtttccgaagagggtctcaagcgtaccgacgagtttcttgatggcgaacatgtcgcaggcatcaagcgaattgtttccgaatccctcgaccgcactgcccgtgctctgcgcaac

SEQ ID NO: 106 - protein, 526 aa, Corynebacterium glutamicum
DDLWLNESFATWSAAISQAEETEYNTAWVTFANVEKSWAYQQDQLPSTHPVFSDGYDIETVDQNFDGITYAKGASVLKQLQAYVGREEFLAGVRRHFANHAWGNASFDDLLGALEQSSGRDLSDWANQWLKTTGINTLGAKFTTDNGKYTSFSVTQTGAAPGAGELRTHRIAVGLYKLVDGSLNRYARVELDCSGASTSVEEIVGLEQADFVLVNDDDLTYALLDLDDDSRNFVIDNIDKFSDPMPRTLVWSAAWEMTRAGQMKARDFIALVARGAAAETEIAVLERILAQATSALKSYADPAWAEATGNDLLADAFLEGARSAEPDSDTQLAFIQALAKATLNDAAADYFRDILAGNVEGLTVDPDLRWWALTALIARGDIEAVEDAIAAELSRDNSSASFLASLRAGAAVNTEEVKAAAYKHVPAVDSGLSNLELRHKIEGLTFTGSFELLQAYNEQYFEILDDVWANFSGEMAQQIVLGLFPSWNVSEEGLKRTDEFLDGEHVAGIKRIVSESLDRTARALRN

SEQ ID NO: 107 - DNA, 964 bp, Corynebacterium glutamicum
  CDS (101)..(964): FRXA01018
tcttaaagttttctagcaatccacactaggcgcgaactatcgtggtgtcattgcgcaccttctaagggtagcgccccctcaaatttcaaggagcattaaattgacgtccactaatctcacccgacaggaagcttcggatcgttcgaggttactgagtgtagaaaactatgacattgcacttgatctcaacaacggtgatgagttttttagttcctccaccgttgtcagcttcactgtcaggaaggctggcgatacctttattgatctccgcgcagcaagcgttgaggaggttcgcctggacaatgtgtccatcaaagatgaggctctaacccttggcaagaacggctacgacgagacgttcggcatcgccctgaagggtcttactcccggcgcgcacaccttgcgggtaacggcgtctatcccctattcccgcaccggtgaaggcctgcaccgcatggtggatccagcagacaatgaggtgtatttgtacacccagtttgagaccgccgatgccaagcgtatgttcgcgtgtttcgatcagccagacctcaaggctacctatgatctgaacatcaaaactcctaagggttggaagatcatttccaactctgagcagcaggtttccactcagcacactgattacgatacccacatttcccgagtggactatcccctctccacctacctgattgcggtgtgcgcgggtcgttaccacgaggtgtgcgatgtctggaagggtacgctcacccaccatgcagaaacacctgccgatcagccaactgagctgactgttccgcttgctctctactgccgcagttctttggctaaagatcttgatgcggtgcgtctgtttaccgaaacgaagcagggctttgattggtaccaccgcaacttcggtgtggcgtacccattcggcaagtacgatcagatcttcgtccctgaatttaatgctggcgcgatggag

SEQ ID NO: 108 - protein, 288 aa, Corynebacterium glutamicum
LTSTNLTRQEASDRSRLLSVENYDIALDLNNGDEFFSSSTVVSFTVRKAGDTFIDLRAASVEEVRLDNVSIKDEALTLGKNGYDETFGIALKGLTPGAHTLRVTASIPYSRTGEGLHRMVDPADNEVYLYTQFETADAKRMFACFDQPDLKATYDLNIKTPKGWKIISNSEQQVSTQHTDYDTHISRVDYPLSTYLIAVCAGRYHEVCDVWKGTLTHHAETPADQPTELTVPLALYCRSSLAKDLDAVRLFTETKQGFDWYHRNFGVAYPFGKYDQIFVPEFNAGAME

SEQ ID NO: 109 - DNA, 1383 bp, Corynebacterium glutamicum
  CDS (101)..(1360): RXA01147
ataatgatcacctactttaacggcttcaggtgacattgtggattcgcattgtggattcgggggcccgcgctgtttccaagaatttggctacccttgttctatgcatgtaactgacgatttcttaagttttattgccctaagcccaagttcctatcacgcggccgcggcggtggagcgcaggttgctccatgaggggttcattcgtcaggaagataccgatgaatgggatgcccgccctggtgggcatgtgacggtgcgtgggggagcagtagtggcgtggtgggtgcctgaggatgcttcgccagattccgggttccgcatcattgggtcacatactgattcaccgggtttcaagttaaagccccgtggggatctttcctcacacggttggcagcaggccggcgtcgaggtttacggcggaccgatcctgccaagctggctggatcgcgagctggccttagcaggccgcattgtgcttgccgacgggtccgtcaagcttgtcaacaccggcccgattctgcgcatcccgcacgtggctattcatttggaccgtactgttaattcccaactcacccttaatccacagcgtcacctgcagcctgtgtttgctgttggtgagcccgacgtatcaattctggatgtcattgctggtgctgcggtagtggatcctgcagatattgtcagccatgatctgatcacggtggctacccaagatgctgaagtatttggcgcacatggggatttcttggcgtctggtcgcctggataacctgagcagcgtgcatccatccatgactgcattgattgcggcttcgcaatctgacgatactggttcggatattttggttcttgctgcattcgatcatgaagaagtgggaagtaattccacctcgggtgccgggggccccctgttggaggatgtgctcaaccgtactgctcgtgcgttgggtgcagatgaagatgagcgacgccggatgtttaaccgttccaccatggtctcagctgacgcggcacactccattcaccccaacttccccgagaagcatgatcaagctaattaccccatcattggtaaaggtcctgtattgaaggtcaacgccaaccagcgctacacctccgatgcagtcacttcaggcatgtggatcagggcatgtcagattgccggtgtgccacaccaggtgtttgccggcaacaacgatgtgccgtgtggttccaccatcggcccgatcagtgcgactcgcctgggtatcgattctgtcgatgtcggtattccattgctgtccatgcactccgcacgcgaaatggccggagtgaaggatctgatgtggtttgaacaagccctggaagcctatctggtaaattaacgccgagttcaatcaagaca

SEQ ID NO: 110 - protein, 420 aa, Corynebacterium glutamicum
MHVTDDFLSFIALSPSSYHAAAAVERRLLHEGFIRQEDTDEWDARPGGHVTVRGGAVVAWWVPEDASPDSGFRIIGSHTDSPGFKLKPRGDLSSHGWQQAGVEVYGGPILPSWLDRELALAGRIVLADGSVKLVNTGPILRIPHVAIHLDRTVNSQLTLNPQRHLQPVFAVGEPDVSILDVIAGAAVVDPADIVSHDLITVATQDAEVFGAHGDFLASGRLDNLSSVHPSMTALIAASQSDDTGSDILVLAAFDHEEVGSNSTSGAGGPLLEDVLNRTARALGADEDERRRMFNRSTMVSADAAHSIHPNFPEKHDQANYPIIGKGPVLKVNANQRYTSDAVTSGMWIRACQIAGVPHQVFAGNNDVPCGSTIGPISATRLGIDSVDVGIPLLSMHSAREMAGVKDLMWFEQALEAYLVN

SEQ ID NO: 111 - DNA, 1260 bp, Corynebacterium glutamicum
  CDS (101)..(1237): RXA01161
tttttcgtgatcaacaatccgctggcatagcgtccagcagatttgattctgacagtgtggtttgatcgcacacctgcctaggctactagggttggagactatgagtgatccttcaacaaacaatttccccacatcggtatatgcacagcgtcttgcggatgcacaagaaggcgcacgcaaggctggcttgaacggtttgatcatcggtacaggcgcagaacttgcgtatctaaccggcagctggatctccacccatgagcgtctaaccgctttggtgatccccagcgaaggaaccgcaaccattgttcttcccgctgtagaccgcggagacttagcactgtctgctattccaggactagacatcaatgtggccggatgggttgatggcgataatgcccatgagttggccgtagatgctctcggtgtttcagagttcgaagcattgggtattggttcctccatcacggcagatcacctgattcctatccagaacctggtgggctccacctgccgcatggagttggcagttcaagtgctgaaagaattgtttgtctctaaagacgaagcagagatcgagcagcttcgcggcgcaggtgcagccattgaccgtgtccacgccaaagtcccggagcttcttcaagacggacgcaccgaagcagaggttgcagcacagctcaacgatctcatcttggaagagcactctgaggtggacttcgtgattgtgggatccgctgaaaacggcgcgaaccctcaccacggtttctctgaccgagtcctccgcaatggcgacatcgtggtggttgatataggaggcaccttcggccctggttaccactctgactgcacacgcacctacattgtgggcggaaaccctgacgatgcggatccagagttcgctaagttctaccaagtgctctacgaagcacagctcgcagccgttgcgcatgttcgccctggcgttactgcagaatcagtggacgctgttgctcgcgatcacattgctgcggctggatacggcgaatacttcattcaccgcacaggacacggcattggtctatccacccatgaggagccattcatcatggcgggtaactcactcgtgttggaagccggaatggccttttccattgagcctggcatctacattgaaggaatccacggagcgcgcatcgaagacatcgttgtggtgaatgaagacggttgtgaaaccctcaacaaccagcccaaggaactgcgttgagcattcttctcctaggcgga

SEQ ID NO: 112 - protein, 379 aa, Corynebacterium glutamicum
MSDPSTNNFPTSVYAQRLADAQEGARKAGLNGLIIGTGAELAYLTGSWISTHERLTALVIPSEGTATIVLPAVDRGDLALSAIPGLDINVAGWVDGDNAHELAVDALGVSEFEALGIGSSITADHLIPIQNLVGSTCRMELAVQVLKELFVSKDEAEIEQLRGAGAAIDRVHAKVPELLQDGRTEAEVAAQLNDLILEEHSEVDFVIVGSAENGANPHHGFSDRVLRNGDIVVVDIGGTFGPGYHSDCTRTYIVGGNPDDADPEFAKFYQVLYEAQLAAVAHVRPGVTAESVDAVARDHIAAAGYGEYFIHRTGHGIGLSTHEEPFIMAGNSLVLEAGMAFSIEPGIYIEGIHGARIEDIVVVNEDGCETLNNQPKELR

SEQ ID NO: 113 - DNA, 980 bp, Corynebacterium glutamicum
  CDS (1)..(957): RXN01181
tctgtactgctcgctcgcgacttggtgaacaccccttcatcacacctgtacccagagtcctactcagtaattgcatccaacgaagcgtccaagcacggcttgcagaccaccatcctggatgagaagcagcttgctgatcaaggtttcggcggcatcctcgcagtcggtaacggctcctcccgcaagcctcgtctgctgcgcatcgattggaagccacgcaaggctaagaagtcgatcgctttggttggcaagggcatcacctttgacaccggcggaatttccatcaagcctggcgcaagcatggagaacatgatctccgacatgggtggatccgcatccgtattggccaccattatcgctgcagctcgtttgaacctgtcgatcaacgtcttcgcgttcctaccaatggctgagaacatgccatccggtgacgctttccgccccggcgatgtcatcactcatttcggtggtatcacctccgaaatcttgaacaccgacgctgaaggccgcctcattctggcagatgccattgcttacgcttctgaagataagcctgactacctcattgatgcggcaaccctgactggtgctcaattagtcgctttaggcctgcggacttcaggtgtcatgggtaccgatgagttccgcgacagcgttgccaagactggccgcgaggttggcgagcaagcatgggcaatgcctcttcctgaagagctcgatgagcaggttaagtcccctgtcgctgacctgcgcaatgtcaccaattcccgtttcgcaggaatgtctgctgcgggtcgttacttgcaggaattcgttggtgccgacatcgagtgggctcacgtcgatatcgctggccctgcatacaacactgctggtgaattcggttacacgccaaagcgcgcaaccggacaaccagtgcgcaccttcgttcaggttctgaaggatctgtcggaaagctaaacgctagttaaagatcagga

SEQ ID NO: 114 - protein, 319 aa, Corynebacterium glutamicum
SVLLARDLVNTPSSHLYPESYSVIASNEASKHGLQTTILDEKQLADQGFGGILAVGNGSSRKPRLLRIDWKPRKAKKSIALVGKGITFDTGGISIKPGASMENMISDMGGSASVLATIIAAARLNLSINVFAFLPMAENMPSGDAFRPGDVITHFGGITSEILNTDAEGRLILADAIAYASEDKPDYLIDAATLTGAQLVALGLRTSGVMGTDEFRDSVAKTGREVGEQAWAMPLPEELDEQVKSPVADLRNVTNSRFAGMSAAGRYLQEFVGADIEWAHVDIAGPAYNTAGEFGYTPKRATGQPVRTFVQVLKDLSES

SEQ ID NO: 115 - DNA, 980 bp, Corynebacterium glutamicum; identical to SEQ ID NO: 113
  CDS (1)..(957): FRXA01181

SEQ ID NO: 116 - protein, 319 aa, Corynebacterium glutamicum; identical to SEQ ID NO: 114

SEQ ID NO: 117 - DNA, 2127 bp, Corynebacterium glutamicum
  CDS (101)..(2104): RXN01277
tactactcggttcacgtttacgtcggctgatccaattggaggcgccctcggaagccgccttaaaaaacctgccggtcaaaagatcactaacctgaacttcatgactgattacacgttcctcgaagacattgacaccccggaagcgctcgcgtgggcggaaaaatggtcgggggaaagcgtcgaaaagctaaaaagcccagccaaggacgccctggaagccaggctgctggctgcgttggacaccgatgatcgcattgcctacgtgagccggcgcggtgagaagctgtacaacttttggcgggacgcgcagcatccgcgtggagtgtggcgcacgaccacgttggagtcgtatgaaagtgaccagccggagtgggacgtgctcattgatgtggatgcgttggcggaggatgagggcgaaaactgggtatggaagggcgcggttgtgcgctcgccggagtttgatcgggcgttggtgaagttctcgcggggcggggctgatgcgacggtgattagggagtttgatctggccacggctgctttcgtggatgattcgccgtttgaattgaaggaggcgaagtccgatgtcacgtgggttgatctggatacgttgctggtgggcacggataccggcgaggggtcactgacggattctgggtacccggcgcgggtgctcacgtggaagcgtgggactccgcttgagcaggcggagttgttctttgaggggtcgcgtcaggatgtggcgactcatgcgtggcgggattcaacacctggttttgagcggacgtttgtgtcaaggtcgttggatttctataattcggagacgtcgctggaaaccgagggtggcctggtcaagcttgatgtgccgaccgattgcgatgtcattgtgaagaagcagtggatttttgtgagtcctcggacggatttcgctgggattccagcaggtggcttgggagtgctgctgttaaaggagttccttgagggcgggcgcgattttcagcctgtgtttacgcctactgagtcgacgtcgctgcagggattggccacgacaaagaatttcctggttttaacgctccttaataatgtctccacagaaatcgtcacagtgccgctcaatgatccgacaacggagcatgaacacattgacctcccagagcatgtcaccgcgcatgtggttgctacctccccgttggatggcgatgaaatttgggtgcaggcagcgagtttcaccgaagcgccaacgttgctgcgtgcggagctgcctggtgcgcttgaggctgtgaagaaggcgccgttgcagtttgaaaatgctggtcaggagactcgtcagcattgggcaacctcggcggatggaacgaagattccgtactttattacaggagccttcgaggaggaaccacaaaacaccctggtccacgcctacggcggcttcgaggtttcccttaccccaagccactccccgacccgcggcatcgcatggttggaaaagggctactactttgtggaagccaacctgcgtggtggcggtgaattcggtccggaatggcattcgcaggcaaccaagctgaaccgcatgaaggtgtgggaggatcaccgcgcggtgctcgccgaccttgtggagcgcggctacgcaacgccggagcagattgcgattcgtggcggatccaacggtggtttgctgacaagtggcgcgttaactcagtacccagaagcattcggtgcggcagttgtgcaggtgccgttggctgatatgttgcgctatcacacctggtcagcgggtgcttcgtggatggcggagtacggcaaccctgacgatccggaggaacgggcggtgattgagcagtactcgccggtgcaggcggtggtgggcgtcgagaagcgaatttatccacccgcattggtgacgacctcaacccgggacgaccgcgtccaccccgcgcacgcgcgcctttttgctcaagctttgcttgatgcgggccaggccgtggattactacgaaaacaccgagggcggccatgccggcgcggcggataacaagcagaccgcgtttgtggaatcgctgatctacacctggatcgagaagactttggatcagcagggtagcatttaatacctatgattatgcgaagg

SEQ ID NO: 118 - protein, 668 aa, Corynebacterium glutamicum
MTDYTFLEDIDTPEALAWAEKWSGESVEKLKSPAKDALEARLLAALDTDDRIAYVSRRGEKLYNFWRDAQHPRGVWRTTTLESYESDQPEWDVLIDVDALAEDEGENWVWKGAVVRSPEFDRALVKFSRGGADATVIREFDLATAAFVDDSPFELKEAKSDVTWVDLDTLLVGTDTGEGSLTDSGYPARVLTWKRGTPLEQAELFFEGSRQDVATHAWRDSTPGFERTFVSRSLDFYNSETSLETEGGLVKLDVPTDCDVIVKKQWIFVSPRTDFAGIPAGGLGVLLLKEFLEGGRDFQPVFTPTESTSLQGLATTKNFLVLTLLNNVSTEIVTVPLNDPTTEHEHIDLPEHVTAHVVATSPLDGDEIWVQAASFTEAPTLLRAELPGALEAVKKAPLQFENAGQETRQHWATSADGTKIPYFITGAFEEEPQNTLVHAYGGFEVSLTPSHSPTRGIAWLEKGYYFVEANLRGGGEFGPEWHSQATKLNRMKVWEDHRAVLADLVERGYATPEQIAIRGGSNGGLLTSGALTQYPEAFGAAVVQVPLADMLRYHTWSAGASWMAEYGNPDDPEERAVIEQYSPVQAVVGVEKRIYPPALVTTSTRDDRVHPAHARLFAQALLDAGQAVDYYENTEGGHAGAADNKQTAFVESLIYTWIEKTLDQQGSI

SEQ ID NO: 119 - DNA, 1812 bp, Corynebacterium glutamicum
  CDS (101)..(1789): FRXA01277
tactactcggttcacgtttacgtcggctgatccaattggaggcgccctcggaagccgccttaaaaaacctgccggtcaaaagatcactaacctgaacttcatgactgattacacgttcctcgaagacattgacaccccggaagcgctcgcgtgggcggaaaaatggtcgggggaaagcgtcgaaaagctaaaaagcccagccaaggacgccctggaagccaggctgctggctgcgttggacaccgatgatcgcattgcctacgtgagccggcgcggtgagaagctgtacaacttttggcgggacgcgcagcatccgcgtggagtgtggcgcacgaccacgttggagtcgtatgaaagtgaccagccggagtgggacgtgctcattgatgtggatgcgttggcggaggatgagggcgaaaactgggtatggaagggcgcggttgtgcgctcgccggagtttgatcgggcgttggtgaagttctcgcggggcggggctgatgcgacggtgattagggagtttgatctggccacggctgctttcgtggatgattcgccgtttgaattgaaggaggcgaagtccgatgtcacgtgggttgatctggatacgttgctggtgggcacggataccggcgaggggtcactgacggattctgggtacccggcgcgggtgctcacgtggaagcgtgggactccgcttgagcaggcggagttgttctttgaggggtcgcgtcaggatgtggcgactcatgcgtggcgggattcaacacctggttttgagcggacgtttgtgtcaaggtcgttggatttctataattcggagacgtcgctggaaaccgagggtggcctggtcaagcttgatgtgccgaccgattgcgatgtcattgtgaagaagcagtggatttttgtgagtcctcggacggatttcgctgggattccagcaggtggcttgggagtgctgctgttaaaggagttccttgagggcgggcgcgattttcagcctgtgtttacgcctactgagtcgacgtcgctgcagggattggccacgacaaagaatttcctggttttaacgctccttaataatgtctccacagaaatcgtcacagtgccgctcaatgatccgacaacggagcatgaacacattgacctcccagagcatgtcaccgcgcatgtggttgctacctccccgttggatggcgatgaaatttgggtgcaggcagcgagtttcaccgaagcgccaacgttgctgcgtgcggagctgcctggtgcgcttgaggctgtgaagaaggcgccgttgcagtttgaaaatgctggtcaggagactcgtcagcattgggcaacctcggcggatggaacgaagattccgtactttattacaggagccttcgaggaggaaccacaaaacaccctggtccacgcctacggcggcttcgaggtttcccttaccccaagccactccccgacccgcggcatcgcatggttggaaaagggctactactttgtggaagccaacctgcgtggtggcggtgaattcggtccggaatggcattcgcaggcaaccaagctgaaccgcatgaaggtgtgggaggatcaccgcgcggtgctcgccgaccttgtggagcgcggctacgcaacgccggagcagattgcgattcgtggcggatccaacggtggtttgctgacaagtggcgcgttaactcagtacccagaagcattcggtgcggcagttgtgcaggtgccgttggctgatatgttgcgctatcacacctggtcagcgggtacctcgtggatgtaggtgtcggcaaccatgggaac

SEQ ID NO: 120 - protein, 563 aa, Corynebacterium glutamicum
MTDYTFLEDIDTPEALAWAEKWSGESVEKLKSPAKDALEARLLAALDTDDRIAYVSRRGEKLYNFWRDAQHPRGVWRTTTLESYESDQPEWDVLIDVDALAEDEGENWVWKGAVVRSPEFDRALVKFSRGGADATVIREFDLATAAFVDDSPFELKEAKSDVTWVDLDTLLVGTDTGEGSLTDSGYPARVLTWKRGTPLEQAELFFEGSRQDVATHAWRDSTPGFERTFVSRSLDFYNSETSLETEGGLVKLDVPTDCDVIVKKQWIFVSPRTDFAGIPAGGLGVLLLKEFLEGGRDFQPVFTPTESTSLQGLATTKNFLVLTLLNNVSTEIVTVPLNDPTTEHEHIDLPEHVTAHVVATSPLDGDEIWVQAASFTEAPTLLRAELPGALEAVKKAPLQFENAGQETRQHWATSADGTKIPYFITGAFEEEPQNTLVHAYGGFEVSLTPSHSPTRGIAWLEKGYYFVEANLRGGGEFGPEWHSQATKLNRMKVWEDHRAVLADLVERGYATPEQIAIRGGSNGGLLTSGALTQYPEAFGAAVVQVPLADMLRYHTWSAGTSWM

SEQ ID NO: 121 - DNA, 526 bp, Corynebacterium glutamicum
  CDS (101)..(526): RXA01914
ggttttgaggaatggctaggcttgttaaaagttagtttcaatttgatgcctcccccaaccaaagcggagacacaacttcaacgagaggactcagctttcaatggcgaaaaatgcctacagcacaacagcaccaaccaaggtgtccaaggatgccactcttccagttcgtggaacggtcgctgaactcaagctcgaaaagaagttgccaaagaagattgatgccatcatcgtcgcgatttttgaaggcgaagattccatcgaactcgccggcggcgaaatcctcgatttcatcttcagtaccgagcagcaggccgacatcctcactcagctcgaagctgtcggcgcaaaggccaccgcaaacagcatcacccgcgtcccaggcaccgacgttgcgcctgtcattgcggttggtttgggcaaggctgatttgcttgacgacgagaccctccgccgcgcttccggcacggcggcccgctccctcggtggttttgaaaatgtcgccaccaccattggcgatttgggactt

SEQ ID NO: 122 - protein, 142 aa, Corynebacterium glutamicum
MAKNAYSTTAPTKVSKDATLPVRGTVAELKLEKKLPKKIDAIIVAIFEGEDSIELAGGEILDFIFSTEQQADILTQLEAVGAKATANSITRVPGTDVAPVIAVGLGKADLLDDETLRRASGTAARSLGGFENVATTIGDLGL

SEQ ID NO: 123 - DNA, 1497 bp, Corynebacterium glutamicum
  CDS (101)..(1474): RXA02048
gcgcggcggataacaagcagaccgcgtttgtggaatcgctgatctacacctggatcgaaaagactttggatcagcagggtagcatttaatacctatgattatgcgaaggctgcgctccaccccggtccctggtacacgcgattcctacacaggaattgatttcaacttaggcttccacatccgacgctacgagcttgatctcacctaccgcgtagcacccaacctgctcatgggcaccgcaacgctgcacatggataattaccgtgcgctcgacgcgctgaccctggacctcggcggcagcctgcgcgtggaaaaagtcaccgccaaaggcaccgccggcacccacatccaagtcgcgcgcttccgccacgccggccgcaaactgcgcatcaccttccgcaaccaaatcccggttgaccaggaattttcactcaccatccgctaccgcggcaacccgcgccccctgcgcagcgaatggggcatgatcggctgggaagagctcgacaacggcgccctcgtcgccgcccagccaaacggcgcgccgagctggttcccctgcgacgacacgcccgacgagaaggcgcttttcgacgtccacttccacaccgacaacggatacgccgccattatcaccggtgatttaatctcaaaacacgtcagtggcagcatgaccacctggcactaccaatcccgcgaacccatggccacctacctcgcagccgtccacgtcggagaatacgacactgtatccctgggcgtttcggaatcgggcgttgtggtggaggcgtatgtgcctgtgggggatgcggccttgcgggctcggattttggaggactttgccaaacaagtcgacatgttagacgcctacgaaaaactcttcggcccctacccattccgcagctaccgcgtagtcatcaccgaagacgaactcgaaatcccactcgaagcccaaggcctctccagcttcggagccaaccacgccaccggcgaaggaacctgggaacgactcatcgcccacgaactctcccaccagtggtttggcaactcactcggcctcgcccaatggaacgacatctggctcaacgaaggcttcgcctgttacgcggaatggctctggtttgaggcagctggagttaagtcggctgcggaaagtgcgttggaattctatcgaggcctggaggcgctgccgaaggatattttgctggccaaccccggcgcgaaggatatgttcgacgaccgcgtctacaagcgcggcgctctgactgtccatgcattgcgggaattgcttggcgatgatgcattcttcaaagctgtgcgctcctacgttgccgaaggccgacacggactcgttgaaccccgcgacctgaaacgacacctctacgcagtctccacagaccacgcagctttagatgcagtgtggcagtcctggcttcgcgatctggagttgccggagtttccttctggtggtttggactagtgcgctatctgacgctggcc

SEQ ID NO: 124 - protein, 458 aa, Corynebacterium glutamicum
MRRLRSTPVPGTRDSYTGIDFNLGFHIRRYELDLTYRVAPNLLMGTATLHMDNYRALDALTLDLGGSLRVEKVTAKGTAGTHIQVARFRHAGRKLRITFRNQIPVDQEFSLTIRYRGNPRPLRSEWGMIGWEELDNGALVAAQPNGAPSWFPCDDTPDEKALFDVHFHTDNGYAAIITGDLISKHVSGSMTTWHYQSREPMATYLAAVHVGEYDTVSLGVSESGVVVEAYVPVGDAALRARILEDFAKQVDMLDAYEKLFGPYPFRSYRVVITEDELEIPLEAQGLSSFGANHATGEGTWERLIAHELSHQWFGNSLGLAQWNDIWLNEGFACYAEWLWFEAAGVKSAAESALEFYRGLEALPKDILLANPGAKDMFDDRVYKRGALTVHALRELLGDDAFFKAVRSYVAEGRHGLVEPRDLKRHLYAVSTDHAALDAVWQSWLRDLELPEFPSGGLD

SEQ ID NO: 125 - DNA, 906 bp, Corynebacterium glutamicum
  CDS (101)..(883): RXN00621
aaatgaatccgggtttttcagtttcggggtgcaaatcagaatgtcgccaatggcgaacacacgagcgtgcagaagatgtgcgtgactaagatcgggggctatgtctgaacgcctaaacgctccgcaagcaccaatccatcccatcacccgaacccaccacggtattgatttcgtagacaactatgaatggctgagggataaagaatcccaagaaaccttggactacctggaggcggagaatgcgttcaccaagcaggagactgaacagctagccacactgcgggacaacatctatgaagagattaagtcacgcgttaaagaaaccgacatgtccatcccagtgcgtgccggaaagcactggtattactctcgcactgaagaaggcaagagctacggctattcctgccgcattccagtgactgaagggtcggatgcatggacccctcctgttatccctgagggtgagccagcgcagggtgaaaccatcatcatggatgccaacgagttggcagaaggccacgaattcttctccatgggtgcatcatctgtcaccacctctggccgctaccttgcgtattccaccgatgtcacgggcgaagagcgctttacgttgcgcatcaaggatctagaaactggcgagctgcttcctgataccctgactggcattttctacggtgctacttgggtgggggaggagtacctcttttaccagcgcgttgatgatgcgtggcgtccagatactgtgtggcgccacaaggtgggtaccccggttgaagaagacgtgttggtgtaccacgagcctgatgaacgttattccacctgggtgggcaccactcgttcagaaaaagttcatcctttttggttgcgcctccaagatcacctctgaagtacgcgtgcttcctttcg

SEQ ID NO: 126 - protein, 261 aa, Corynebacterium glutamicum
MSERLNAPQAPIHPITRTHHGIDFVDNYEWLRDKESQETLDYLEAENAFTKQETEQLATLRDNIYEEIKSRVKETDMSIPVRAGKHWYYSRTEEGKSYGYSCRIPVTEGSDAWTPPVIPEGEPAQGETIIMDANELAEGHEFFSMGASSVTTSGRYLAYSTDVTGEERFTLRIKDLETGELLPDTLTGIFYGATWVGEEYLFYQRVDDAWRPDTVWRHKVGTPVEEDVLVYHEPDERYSTWVGTTRSEKVHPFWLRLQDHL

SEQ ID NO: 127 - DNA, 906 bp, Corynebacterium glutamicum; identical to SEQ ID NO: 125
  CDS (101)..(883): FRXA00621

SEQ ID NO: 128 - protein, 261 aa, Corynebacterium glutamicum; identical to SEQ ID NO: 126

SEQ ID NO: 129 - DNA, 1539 bp, Corynebacterium glutamicum
  CDS (101)..(1516): RXN00622
ttttaccagcgcgttgatgatgcgtggcgtccagatactgtgtggcgccacaaggtgggtaccccggttgaagaagacgtgttggtgtaccacgagcctgatgaacgttattccacctgggtgggcaccactcgttcagaaaaagttcatcctttttggttgcgcctccaagatcacctctgaagtacgcgtgcttcctttcgaccagccagagggcacccctgaggtgctgattccgcgcgcggagggtgtggaatacgacgtcgatcatgcagtcgtagacggctccgatatttggttggtcacacacaacgccgagggcccgaacttttcggtggggtgggctggcgtcgacaagctcaattctttggacgcgctggcgccactcgtcgcgcacaaggatgacgtgcgcattgagggtgtcgatacctaccgcgatttcatcatcctgggctacaggtccggcgcgatcggccaggtcgcgatcatgaagcttatcgacggaaccttcggcgatttccaacagctggaatttgacgaggaaatctacaccgtcgcatcgggcggaaacccagaatgggacgcccccgtcattcgcctttcttacggatcattcaccaccccggcgcagctgtttaactactggattgaatccggcgaacgcacgctgctgaagcagcaggaagtgctcggcggatacaagccgtcagactatgtggcctcccgattgtgggtcactgcgaaagatggcgcgcagattccagtgtccttggtgcaccgcaccgacctggatgtatccaagcccaaccccacgttgctctacggctatggttcctacgaatcatccattgatccaggcttctctatcgcgcgtttgtcactgatggatcgtggcatgatttttgcgattgcccacgttcgtggcggtggcgaaatgggtcgtggctggtacgacaacggcaaaaccaccacgaagaaaaacaccttcaccgacttcattgatgttgccgacgccctcatcgagcagaagatttctgcccctgaaatgctggttgcagaaggcggctcagctggtggcatgctcatgggcgccattgccaacatggccggtgaccgcttcaaggcgatcgaagccaacgtgccattcgtcgatccgctgacctctatgctcatgccggaactgccactgacggttatcgaatgggatgagtggggcgatccactccacgataaggacgtctatgaatacatggcgtcgtatgccccatatgaaaacatcgaggcaaagaactaccccaatatcttggccgtaacatcgctcaacgacacccgagtgttgtacgtcgaaccagccaaatgggtagcgcagcttcgggcgactgcaaccggtggagaattccttctgaaaactgaaatggttgccggacacggcggtgtgtcaggacgctacgaaaagtggcgtgagactgcatttgagtacggctggttgatcaaccaagcaaccggtgtgaccgaataaaacttgttcgactagcgaac

SEQ ID NO: 130 - protein, 472 aa, Corynebacterium glutamicum
MNVIPPGWAPLVQKKFILFGCASKITSEVRVLPFDQPEGTPEVLIPRAEGVEYDVDHAVVDGSDIWLVTHNAEGPNFSVGWAGVDKLNSLDALAPLVAHKDDVRIEGVDTYRDFIILGYRSGAIGQVAIMKLIDGTFGDFQQLEFDEEIYTVASGGNPEWDAPVIRLSYGSFTTPAQLFNYWIESGERTLLKQQEVLGGYKPSDYVASRLWVTAKDGAQIPVSLVHRTDLDVSKPNPTLLYGYGSYESSIDPGFSIARLSLMDRGMIFAIAHVRGGGEMGRGWYDNGKTTTKKNTFTDFIDVADALIEQKISAPEMLVAEGGSAGGMLMGAIANMAGDRFKAIEANVPFVDPLTSMLMPELPLTVIEWDEWGDPLHDKDVYEYMASYAPYENIEAKNYPNILAVTSLNDTRVLYVEPAKWVAQLRATATGGEFLLKTEMVAGHGGVSGRYEKWRETAFEYGWLINQATGVTE

SEQ ID NO: 131 - DNA, 1539 bp, Corynebacterium glutamicum; identical to SEQ ID NO: 129
  CDS (101)..(1516): FRXA00622

SEQ ID NO: 132 - protein, 472 aa, Corynebacterium glutamicum; identical to SEQ ID NO: 130

SEQ ID NO: 133 - DNA, 1629 bp, Corynebacterium glutamicum
  CDS (101)..(1606): RXN00982
gaaaacaaacgtccttgaagccgtaatgccccgttcgacaataaaaagggtagtagcagttcttgccgcctcgactgcgcttagcccctttttggtatcaatgcccactgcagcagcgcaagaaaacatccgctgggaagaatgcccacctcaggtagatattgcctccgctcaatgtggcagcatcgacgtgcccatgcactattctgatccctcacttggcgatatcagcgtgggctttgtcaaggtccctgcccaaggcgaaaagcacggcaccatcttcggtaactccggtggccctggtggcgatgcctatagcttcttcggcagccaatccatgaactggccagaagccatgtaccaaaactacgacctcgttgcagtgcagcctcgcggaatggtcggctccacaccggttaactgcgacaacatcgcaccaggatacgatttcctctcgctgctcacccgcgaaggcgctttcgttaaagaatcctgcgagatcggcacccccggctacacctccagcctgaccaccgacaacaccgccaacgactgggagcgcgtccgccaagcacttggcgatgacaagatctccatcttcggactgtcctacggaacctacctcggatcggtctacgccacccgctacccacagcacaccgacaaggttgtcctcgattccgcaatggcgcccagcctggcatggaacggcatcatggcctcccaagaacagggctacaaaaactccctcaacgacttcttcacctgggttgcagaaaacaacgacacgtatggcctcggcactaccccactagccgtgtaccaaaactggtcaaacaagatcgtcgccgaaaccggaaccaacccaaccgttgctccaccaccagcacaagttggcgatgtcccaccagcattcgcatgggccggccaagcaggcgcagacatgatgaccgccaccaacccaacctccgtgcaactccagggccttgccacccagctcctaaaccctggatccaaccagtcactgagccctctgctcaacgtcacccgcgcctacattccacagccatcaacctggcccatgctcgcaggcgccatctcagggcaaacacccatccctgacgtaactgacaccggcgacgacccatacgtcatcgaaagcatcaacgccagcgtcaacatgcagcgcatggtcatgtgcaacgaaaacaccgtcgcaccagacccagtagcaatggcacgcatggcctggacaagcatggtcaccggcgacgtctttgacatttactccgttaaattcagctccggacaagcctgctccggcatcaccccaacaagcggccgccagccaaccgacggatctcaactagcagtccaaccactactcctccagggaaccagcgacccacaaaccccatactggacccacaacgagcttgccgacgccatgaacgcccacgtggtcaccgtcaacggaccaggacacggccaatccatcggcggcaccaaccaagcaatcaacgacattgttgtggactacctccgcaccggacacaccgacgccacctgggtcgaaggcaacacacccaccccaattacggctggctaattgctttccacttagtagat

SEQ ID NO: 134 - protein, 502 aa, Corynebacterium glutamicum
MPTAAAQENIRWEECPPQVDIASAQCGSIDVPMHYSDPSLGDISVGFVKVPAQGEKHGTIFGNSGGPGGDAYSFFGSQSMNWPEAMYQNYDLVAVQPRGMVGSTPVNCDNIAPGYDFLSLLTREGAFVKESCEIGTPGYTSSLTTDNTANDWERVRQALGDDKISIFGLSYGTYLGSVYATRYPQHTDKVVLDSAMAPSLAWNGIMASQEQGYKNSLNDFFTWVAENNDTYGLGTTPLAVYQNWSNKIVAETGTNPTVAPPPAQVGDVPPAFAWAGQAGADMMTATNPTSVQLQGLATQLLNPGSNQSLSPLLNVTRAYIPQPSTWPMLAGAISGQTPIPDVTDTGDDPYVIESINASVNMQRMVMCNENTVAPDPVAMARMAWTSMVTGDVFDIYSVKFSSGQACSGITPTSGRQPTDGSQLAVQPLLLQGTSDPQTPYWTHNELADAMNAHVVTVNGPGHGQSIGGTNQAINDIVVDYLRTGHTDATWVEGNTPTPITAG

SEQ ID NO: 135 - DNA, 1114 bp, Corynebacterium glutamicum
  CDS (101)..(1114): FRXA00977
gaaaacaaacgtccttgaagccgtaatgccccgttcgacaataaaaagggtagtagcagttcttgccgcctcgactgcgcttagcccctttttggtatcaatgcccactgcagcagcgcaagaaaacatccgctgggaagaatgcccacctcaggtagatattgcctccgctcaatgtggcagcatcgacgtgcccatgcactattctgatccctcacttggcgatatcagcgtgggctttgtcaaggtccctgcccaaggcgaaaagcacggcaccatcttcggtaactccggtggccctggtggcgatgcctatagcttcttcggcagccaatccatgaactggccagaagccatgtaccaaaactacgacctcgttgcagtgcagcctcgcggaatggtcggctccacaccggttaactgcgacaacatcgcaccaggatacgatttcctctcgctgctcacccgcgaaggcgctttcgttaaagaatcctgcgagatcggcacccccggctacacctccagcctgaccaccgacaacaccgccaacgactgggagcgcgtccgccaagcacttggcgatgacaagatctccatcttcggactgtcctacggaacctacctcggatcggtctacgccacccgctacccacagcacaccgacaaggttgtcctcgattccgcaatggcgcccagcctggcatggaacggcatcatggcctcccaagaacagggctacaaaaactccctcaacgacttcttcacctgggttgcagaaaacaacgacacgtatggcctcggcactaccccactagccgtgtaccaaaactggtcaaacaagatcgtcgccgaaaccggaaccaacccaaccgttgctccaccaccagcacaagttggcgatgtcccaccagcattcgcatgggccggccaagcaggcgcagacatgatgaccgccaccaacccaacctccgtgcaactccagggccttgccacccagctcctaaaccctggatccaaccagtcactgagccctctgctcaacgtcacccgcgcctacattccacagccatcaacctggcccatgctcgcaggcgccatctcagggcaaacaccc

SEQ ID NO: 136 - protein, 338 aa, Corynebacterium glutamicum
MPTAAAQENIRWEECPPQVDIASAQCGSIDVPMHYSDPSLGDISVGFVKVPAQGEKHGTIFGNSGGPGGDAYSFFGSQSMNWPEAMYQNYDLVAVQPRGMVGSTPVNCDNIAPGYDFLSLLTREGAFVKESCEIGTPGYTSSLTTDNTANDWERVRQALGDDKISIFGLSYGTYLGSVYATRYPQHTDKVVLDSAMAPSLAWNGIMASQEQGYKNSLNDFFTWVAENNDTYGLGTTPLAVYQNWSNKIVAETGTNPTVAPPPAQVGDVPPAFAWAGQAGADMMTATNPTSVQLQGLATQLLNPGSNQSLSPLLNVTRAYIPQPSTWPMLAGAISGQTP

SEQ ID NO: 137 - DNA, 269 bp, Corynebacterium glutamicum
  CDS (1)..(246): FRXA00982
tctcaactagcagtccaaccactactcctccagggaaccagcgacccacaaaccccatactggacccacaacgagcttgccgacgccatgaacgcccacgtggtcaccgtcaacggaccaggacacggccaatccatcggcggcaccaaccaagcaatcaacgacattgttgtggactacctccgcaccggacacaccgacgccacctgggtcgaaggcaacacacccaccccaattacggctggctaattgctttccacttagtagat

SEQ ID NO: 138 - protein, 82 aa, Corynebacterium glutamicum
SQLAVQPLLLQGTSDPQTPYWTHNELADAMNAHVVTVNGPGHGQSIGGTNQAINDIVVDYLRTGHTDATWVEGNTPTPITAG

SEQ ID NO: 139 - DNA, 1419 bp, Corynebacterium glutamicum
  CDS (101)..(1396): RXA00152
gtcattgatatccaaggcacgaccgcgattgtatggaaagaagcctaaatttttaacaatcaaatagtactggccattcccaactaaaactggagtaacgatgacaggactaatcctcgccatagttttcctggtctttgtcgccgtcgtggtgatcaagtccatagccctgattccccagggtgaagccgccgtcattgaacgccttggtagctacacccgcaccgtttcaggtggcctgaccctgctggttccattcgtggaccgagtacgcgcaaggatcgacacccgtgagcgcgtggtctcattcccaccgcaggctgttattacccaagacaacctgaccgtggccatcgatatcgtggtgaccttccaaatcaacgaaccagagcgcgccatctacggcgtggacaactacatcgtcggtgtggagcagatttctgtagcaacacttcgagacgttgtcggtggcatgaccctggaagaaaccctcacttcacgtgacgtgatcaaccgccgcctccgtggcgagctcgatgcagcaaccaccaaatggggcctgcgcatcagccgtgtggaactaaaggcaattgatccgccaccatccatccagcaatcgatggaaaagcagatgaaggcagaccgtgaaaagcgcgccaccattttgaccgcagaaggtcagcgcgaagccgacatcaaaactgccgaaggtgaaaagcaagccaagatcctccaagctgagggtgaaaagcacgcatccatcctgaacgcagaagcagaacgccaagcgatgatcctgcgcgccgaaggtgaacgcgcagcacgctacctccaggcgcagggtgaagcccgagcaatccaaaaggtcaacgcagcaatcaagtctgccaagttgaccccagaggttcttgcttatcaatacctcgaaaagcttcctaagatcgcagagggcaacgcctccaagatgtgggtcatcccaagccagttctccgattctctggaaggttttgcgaagcagttcggcgcaaaggatgcagaaggtgtcttccgctacgaaccaaacaccgtggatgaagaaacccgcgacatcgcaaacgccgacaacgtggaagactggttctccaccgaatcagaccctgaaatcgcagcagcagtcgccgcagcaaacgccgtggccaacaagccagtcgatccagaacccggtgagatcctttccaagaagaccgcacgacgcgttgaacctgaagcagtattggaggctttgcaaaacggaaccactacacaacctgaggttgaggcagcacctcctaccgcaaacttcgcccaagaattccctgcaccacaggcaaaccctgaagattactccgaccaacaccgagagaatccttacggaaactaatcaggcataagaaaaggcgg

SEQ ID NO: 140 - protein, 432 aa, Corynebacterium glutamicum
MTGLILAIVFLVFVAVVVIKSIALIPQGEAAVIERLGSYTRTVSGGLTLLVPFVDRVRARIDTRERVVSFPPQAVITQDNLTVAIDIVVTFQINEPERAIYGVDNYIVGVEQISVATLRDVVGGMTLEETLTSRDVINRRLRGELDAATTKWGLRISRVELKAIDPPPSIQQSMEKQMKADREKRATILTAEGQREADIKTAEGEKQAKILQAEGEKHASILNAEAERQAMILRAEGERAARYLQAQGEARAIQKVNAAIKSAKLTPEVLAYQYLEKLPKIAEGNASKMWVIPSQFSDSLEGFAKQFGAKDAEGVFRYEPNTVDEETRDIANADNVEDWFSTESDPEIAAAVAAANAVANKPVDPEPGEILSKKTARRVEPEAVLEALQNGTTTQPEVEAAPPTANFAQEFPAPQANPEDYSDQHRENPYGN

SEQ ID NO: 141 - DNA, 1098 bp, Corynebacterium glutamicum
  CDS (101)..(1075): RXA02558
ccctcccgaaattagaaatccccttttaatgtgatatcactttctgttaaactgatatcacattctttttcagcaccccagacttaaaaggagcaccaccatgagcaccatagaagagcgcactcctggagctgtcgccacagaaccagtgggacacgaaggcgcacgcgtcagcattaatgagaagaacgtgtggtctttgggcgcaggtccagcagctttcgcactgctcgcaatgattgtgctcatgattgccagtggagttttcttcgctcaatccatcaacactttagaaaacgatggcggtggaacacttgcggttacgggactgattgccagcatcgtcgttttcactgttgcattggtggtcaccataacttcggtgaaggtggtcagccctggacatactctgactgtgcagttctttggacgatacatcggaaccctgcgtcgaactgggttgtctttcgttcccccactgtctgtgacgaagaaagtgtccgtgagggtccgaaactttgaaaccaacgaagccaaagttaatgactacaacggcaaccccatcaacattgcagcgatcatcgtgtggcaggtagccgatactgcacaggctagcttctctgtggaggatttcgaagagttcctgcaccagcaggccgagtccgcactgcgtcacgtggcaacccagcacccctatgattccccagttgatggtcgtgtttccttgcgtggcgctaccgatgaggtcagtgaagaactcgcagatgaggtggcacaacgagcagctgttgcaggtcttgaaatcgtcgaagcccgcatctcttccttgagctacgcaccggaaattgcccaggcgatgctgcagcgccagcaggcttccgcgattgttgatgcccgcgaaaagatcgtcgagggcgctgtcaccatggtggaaaccgcacttgaccagcttgagcaacgtgaaattgtggatttggatccagagcgacgcgccgcgatggtttccaacctgttggttgtgttgtgttccgacaccaatgctcagccaatcgtcaacgccggtagcctctaccaataagacaatggcccgcaaacagg

SEQ ID NO: 142 - protein, 325 aa, Corynebacterium glutamicum
MSTIEERTPGAVATEPVGHEGARVSINEKNVWSLGAGPAAFALLAMIVLMIASGVFFAQSINTLENDGGGTLAVTGLIASIVVFTVALVVTITSVKVVSPGHTLTVQFFGRYIGTLRRTGLSFVPPLSVTKKVSVRVRNFETNEAKVNDYNGNPINIAAIIVWQVADTAQASFSVEDFEEFLHQQAESALRHVATQHPYDSPVDGRVSLRGATDEVSEELADEVAQRAAVAGLEIVEARISSLSYAPEIAQAMLQRQQASAIVDAREKIVEGAVTMVETALDQLEQREIVDLDPERRAAMVSNLLVVLCSDTNAQPIVNAGSLYQ

SEQ ID NO: 143 - DNA, 798 bp, Corynebacterium glutamicum
  CDS (101)..(775): RXA00500
caccagccagcatgaacacaatggacttcgtgccagctcaggcgcagtactgaagcaccttttcgatctggcccacggccgagaggtacgctgattcctcgtgttagtactagccctagacacctcaacccctgacctgatcgtcggcgtcgtcgactccgacaccggaaacacccgcgccgaaaccatcatcgaggacacccgcgcacacaacgagcagctcacgcccaccgtccagaagacgcttctcgacgccaacttgagcttttcagatatcgacgcgatcgtcgtgggttgcggcccgggaccgttcactggacttcgagtaggcatggtgtccggcgcagcgttcggtgatgccctgggaatccctgtctatggagtctgctcactcgacgcgatcgctcacaatattggtgcacgcaacatcccgcacgcattagttgccactgatgcgcgccgccgtgaaatctactgggcaacctaccgctccggcgaacgtgatcagggaccagatgtcatcgcaccagcaaacatccagatcagcggcgctgtagacaccatttcgattcctgagcacctggtggaaaaactcccagaagaactccagaatgtcaccatgcatagcggcaaacctgcccccgcaagcttggtggcagtggctgatttcagtgtggaaccacaaccattggttcctctttacctgcgccgcccagatgccaaagaaccaaaaccaaaacctaaatctgcagccatccccgaggtggatctttcatgagtgaacaattcgagctacgg

SEQ ID NO: 144 - protein, 225 aa, Corynebacterium glutamicum
VLVLALDTSTPDLIVGVVDSDTGNTRAETIIEDTRAHNEQLTPTVQKTLLDANLSFSDIDAIVVGCGPGPFTGLRVGMVSGAAFGDALGIPVYGVCSLDAIAHNIGARNIPHALVATDARRREIYWATYRSGERDQGPDVIAPANIQISGAVDTISIPEHLVEKLPEELQNVTMHSGKPAPASLVAVADFSVEPQPLVPLYLRRPDAKEPKPKPKSAAIPEVDLS

SEQ ID NO: 145 - DNA, 630 bp, Corynebacterium glutamicum
  CDS (101)..(607): RXA00501
tggaaccacaaccattggttcctctttacctgcgccgcccagatgccaaagaaccaaaaccaaaacctaaatctgcagccatccccgaggtggatctttcatgagtgaacaattcgagctacgggaactccgcagggaagacgcggggcgctgcgccgacctggagcaaatcctgttcccaggtgataacccctggccacgtgatgtctttgccgtggagttttcccaccccaccaatttctacatcggcgctttcgacgaaggatacttggtggcgtacgcaggtcttgccatgatgggacctgcggatgatccagagtttgaaatccacaccattggtgtcgatccggaattccaaagaaaaggcttgggacgcgtactcatggatcaaatgatgcatgcagcggacagccacgacggtccagttttcttggaagtccgcaccgacaacgtacccgcgatttccatgtacgaggctttcggctttaaaaccttggccgtgcgcaaaaactactaccggccatccggagctgacgcctacaccatgcaacgcccacgcttgagcgatcgcaaagatcaacagacagacacagaggggacacccagctaaaccatgatcgttttgggaat

SEQ ID NO: 146 - protein, 169 aa, Corynebacterium glutamicum
MSEQFELRELRREDAGRCADLEQILFPGDNPWPRDVFAVEFSHPTNFYIGAFDEGYLVAYAGLAMMGPADDPEFEIHTIGVDPEFQRKGLGRVLMDQMMHAADSHDGPVFLEVRTDNVPAISMYEAFGFKTLAVRKNYYRPSGADAYTMQRPRLSDRKDQQTDTEGTPS

SEQ ID NO: 147 - DNA, 1155 bp, Corynebacterium glutamicum
  CDS (101)..(1132): RXA00502
ctaccggccatccggagctgacgcctacaccatgcaacgcccacgcttgagcgatcgcaaagatcaacagacagacacagaggggacacccagctaaaccatgatcgttttgggaattgaaagctcctgcgatgaaacaggcgtaggcgtagtcaaacttgacggcgaaggaaacctagagatcctcgccgactcagtggcctcctccatgcaagaacatgcccgctttggtggcgtcgtgccagaaatcgcctcccgggcgcacctggaatctatggtccccgtgatgcgtgaagcgttgaggcaggcgggcgtcgacaggccagatgctgtggctgcaaccgtgggccctggtttggcgggcgcgctgctcgttggagccagcgctgcgaaggcgtatgccgctgcgtggggagttccgttttacgcggtcaaccacctgggcggacacgtcgccgtggccaatctggaaggtgaaactcttccacacgcggtggctttgctggtttccggcggacacactcaattgttggaagtcgacgcggtgggattacccatgaaggaattgggatccaccctcgacgatgccgctggcgaagcctatgacaaagtctcaaggctgttgggattgggctacccaggcggccccatcattgataaattggcgcgccggggtaatccagaggccattgctttcccccgcggattgatgaaaaagtcggattctcggcatgatttcagcttttccggtttgaaaacctccgttgcccgctacgtggaagctgcggaaagaaacggtgaagttatttccgtggaggacgtctgcgcatcattccaagaagcggtgtgtgatgtgttgacgtttaaggccgtgcgtgcgtgccgcgatgtcggtgcgaaggtgctgctgttgggtggaggagtggctgccaactctcgtctgcgggagcttgctcaagaacgttgcgataaagccgacatcgaactccgggttcctcgtttcaatttgtgcaccgataatggtgtcatgattgcagcgttggcggctcaaagaatccacgaaggtgcccaagaatcaccaatttcggtcggaactgatccttctttgtccgttgagaccccacaggtgttttaaacatttagtattagttccat

SEQ ID NO: 148 - protein, 344 aa, Corynebacterium glutamicum
MIVLGIESSCDETGVGVVKLDGEGNLEILADSVASSMQEHARFGGVVPEIASRAHLESMVPVMREALRQAGVDRPDAVAATVGPGLAGALLVGASAAKAYAAAWGVPFYAVNHLGGHVAVANLEGETLPHAVALLVSGGHTQLLEVDAVGLPMKELGSTLDDAAGEAYDKVSRLLGLGYPGGPIIDKLARRGNPEAIAFPRGLMKKSDSRHDFSFSGLKTSVARYVEAAERNGEVISVEDVCASFQEAVCDVLTFKAVRACRDVGAKVLLLGGGVAANSRLRELAQERCDKADIELRVPRFNLCTDNGVMIAALAAQRIHEGAQESPISVGTDPSLSVETPQVF

SEQ ID NO: 149 - DNA, 888 bp, Corynebacterium glutamicum
  CDS (101)..(865): RXN02589
gcctaaattgcagcgagaggtctaaaaggtagtgctctagggattcatccaaactcacgaatattgaagttttaaagttgaacaggaaaaataacaaataatgtctatttctgataattcccgcgatcaattaggagaactgccagctggtcggcctctccaatccgattttgataatgacctcgactacccacgtctaggcagtgtcacgtttaggcgtggcaccctcactgaaaaccagcaaaccatgtgggatgaaaagtggcctgaactgggtcgcgtcctcgaagatgagctgattgatgttgatgcgtggttcgggcgcgaaggcgcaaaaaccatcgtagagatcggctctggcactggaacttcgactgctgccatggctccacttgaggctgataccaacattgtcgccgtcgaactatacaagccgggcttggccaagttgatgggctctgttgtccgtggagagatcgacaacgtgcgcatggtccgcggagacggcatcgaggtgctcaaccgcatgtttgccgatgggtccctggacggcatccgcgtatacttcccggacccttggccaaaggcgcgccacaacaagcgccgcatcatccagtctggtccgctgaacctgtttgcaaagaagctcaagccaggtggagttctgcacgttgctaccgaccacgctgattacgcagagtggatcaatgagctagttgaggtcgaaccactgcttgagtacaaaggctggccatgggaggaatgccctcagctgactgaccgtcaggtcatcaccaagtttgaaggcaaaggcttggaaaaagatcacgtgatcaatgagtacttgtggcagaaggtgcaaaactaatgtctgatgtgcatgaggtc

SEQ ID NO: 150 - protein, 255 aa, Corynebacterium glutamicum
MSISDNSRDQLGELPAGRPLQSDFDNDLDYPRLGSVTFRRGTLTENQQTMWDEKWPELGRVLEDELIDVDAWFGREGAKTIVEIGSGTGTSTAAMAPLEADTNIVAVELYKPGLAKLMGSVVRGEIDNVRMVRGDGIEVLNRMFADGSLDGIRVYFPDPWPKARHNKRRIIQSGPLNLFAKKLKPGGVLHVATDHADYAEWINELVEVEPLLEYKGWPWEECPQLTDRQVITKFEGKGLEKDHVINEYLWQKVQN

SEQ ID NO: 151 - DNA, 888 bp, Corynebacterium glutamicum; identical to SEQ ID NO: 149
  CDS (101)..(865): FRXA02589

SEQ ID NO: 152 - protein, 255 aa, Corynebacterium glutamicum; identical to SEQ ID NO: 150

SEQ ID NO: 153 - DNA, 948 bp, Corynebacterium glutamicum
  CDS (101)..(925): RXA00226
ccgcctgcggtgtcagcggagcgcgcccggcgtctgaaaactgcacttggtgagaacgtgattgttcatgatgtcacctgttccatcggtacggaggggcatgaacttatcgatgccggccttcgctacctgggttctgatcctagatttctcacgcaccctcatggcagcccacaatctccagggcaaaaacgccctgattttccgcgccgacgcgctccagcccgcaagcaggggagccgacgtcatcatcgcggaccctgccagacgcgccgggggcaagcgcattacaaatccggcacagctcctgccacctctgccttcgcttctcgacgcctggatcaaccaaccactcgccgttaaatgtgcccccggccttgatttttcggaatggccaggtctcgtcagtattgccagcgttgatggaggcgtgaaagaagcatgcctctacactacggatctggcagatggggaaactcgcgaagctatcgtgatcaaagatgggctcattgaccgcatcaccaactttgaagacgatgccacgggacaagaccttgcggctgcacctggtgagttcatcatcgacccagacggtgccatcgtgcgcgccgggttggttcgccactatgcagtgcgtgagcagctgtggatgttggatgagcggatcgcataccttacgggcaatcggattccagagggtaccagcggttttaggtttattgaagaggttccgctgaagaagctgaaatcggcgatggcagcacatgatgcgggggcggttgaaattttagtgcgtggtgttgatgttgatcctgatcagttgcggaaaagattgcagctgaagggtaccaaggcgatgtctgtggtgatcactcgaattggcagccgaggggttgcattgatttgtggtcctcgcgagcgcgcctaaagccgatgcaaataaaattg

SEQ ID NO: 154 - protein, 275 aa, Corynebacterium glutamicum
MNLSMPAFATWVLILDFSRTLMAAHNLQGKNALIFRADALQPASRGADVIIADPARRAGGKRITNPAQLLPPLPSLLDAWINQPLAVKCAPGLDFSEWPGLVSIASVDGGVKEACLYTTDLADGETREAIVIKDGLIDRITNFEDDATGQDLAAAPGEFIIDPDGAIVRAGLVRHYAVREQLWMLDERIAYLTGNRIPEGTSGFRFIEEVPLKKLKSAMAAHDAGAVEILVRGVDVDPDQLRKRLQLKGTKAMSVVITRIGSRGVALICGPRERA

SEQ ID NO: 155 - DNA, 924 bp, Corynebacterium glutamicum
  CDS (101)..(901): RXN01885
gtggcgtcgcagggatgttcctgcggcaccatttttgctgaggtggaactcacggattaaacacggatttttctaaggttaatcaagtaaggtttaccttatgactacgaaacctatcatcccagaatcaacccactccgcagaacgtgctggtggacattggatccttgccaggcttggaaagaaagtgctgcgccctggaggtcgtgaaacaacgcagttcctgctggagaacctttctttgaccggtgctaccgtggtggaatttgctccaggacttggcgtgactgcacgtgacatccttggcaagggtccggctcgctacatcggagtggatagcgacgcggatgcatgcgcgaatgtacgtgcgatcttacctgctggtcctcacgaggtgcgcaatacaaatgccaccgatactggccttgaaagcgactcgtttgatgttgtcatcggcgaagcgatgttgaccatgcagaccgataagcacaagttggagctgatgcgcgaggcagctcgaattctgaaaccaggcgggctgtacggcattcacgagctgtcgctggtgcctgacaatgtctccactgcggtgaaagaggatattgctaaggcgctggctcgttccatcaaagtcaatgcccgccccatcacggtgccggaatgggctgcgttggcgcgtgaggcagggttcgatgtgattaatattcgccaagccgacatggcccttctatccctcaagcggaacctgaaggatgaagggctaaaaggtgtcttcacgattgtgaggaacgtgattagccaaccggatctgcgcaagcgagtgctcggaatgcgaaagactttcaccgagcataaagatcacttaggtgcggttggcatcattttgcagaagagagcccaatagggatctgaaatggaggggtg

SEQ ID NO: 156 - protein, 267 aa, Corynebacterium glutamicum
MTTKPIIPESTHSAERAGGHWILARLGKKVLRPGGRETTQFLLENLSLTGATVVEFAPGLGVTARDILGKGPARYIGVDSDADACANVRAILPAGPHEVRNTNATDTGLESDSFDVVIGEAMLTMQTDKHKLELMREAARILKPGGLYGIHELSLVPDNVSTAVKEDIAKALARSIKVNARPITVPEWAALAREAGFDVINIRQADMALLSLKRNLKDEGLKGVFTIVRNVISQPDLRKRVLGMRKTFTEHKDHLGAVGIILQKRAQ

SEQ ID NO: 157 - DNA, 924 bp, Corynebacterium glutamicum; identical to SEQ ID NO: 155
  CDS (101)..(901): FRXA01885

SEQ ID NO: 158 - protein, 267 aa, Corynebacterium glutamicum; identical to SEQ ID NO: 156

SEQ ID NO: 159 - DNA, 894 bp, Corynebacterium glutamicum
  CDS (101)..(871): RXA02592
aaacaccaccattgtttcctccatcgacgatgccatcaccaccattttgcgatggatgaacggcgaagacatccgcgacctcaactggacccgcgcataaatggcctcatttccggagcttccggctcttcgtcgcttggctaccttgggcaggtcgtggggtttactgtctgatttcaaatacgaacaaacccgacctgacatcttttacggaaacctggccctcgatacctcgagtctggtggcggctttgtctgaagatatttctggcgccggattaaatgacctgaaagttctcgacgtcggcggcggacccggatacttcgccgaagcctttgagacactgggcgccacctacttctccgtcgaacccgacgttggcgaaatgtccgcagctggcatcgacgtccacggatcagtccgcggatccggcctcgacctgccgtttcttcccgattcctttgacgtggtgtactcctccaacgttgcagaacatgtctccgcaccgtgggaattgggagaagaaatgctccgcgtcacccgcagcggcggcctggcaatcctgagctacaccatttggttagggcccttcggcggccatgaaaccggactgtgggaacactacgttggcggagaatttgcccgcgatcgctacacgaagaaacacgggcacccgcctaagaacgttttcggggagtcactgtttaatgtgtcctgccgggaggggctggaatggggagcctccgtgggcaatgcggaattggttgccgcttttccccgctaccacccgtattgggtctggtggatggttaaagtcccagtgctccgagaattcgcggtaagtaacttggtgttggtgtttaaaaagcactgaggttttgaggaattcatcgc

SEQ ID NO: 160 - protein, 257 aa, Corynebacterium glutamicum
MASFPELPALRRLATLGRSWGLLSDFKYEQTRPDIFYGNLALDTSSLVAALSEDISGAGLNDLKVLDVGGGPGYFAEAFETLGATYFSVEPDVGEMSAAGIDVHGSVRGSGLDLPFLPDSFDVVYSSNVAEHVSAPWELGEEMLRVTRSGGLAILSYTIWLGPFGGHETGLWEHYVGGEFARDRYTKKHGHPPKNVFGESLFNVSCREGLEWGASVGNAELVAAFPRYHPYWVWWMVKVPVLREFAVSNLVLVFKKH

SEQ ID NO: 161 - DNA, 720 bp, Corynebacterium glutamicum
  CDS (101)..(697): RXN01795
agaccatattgaagacctcgaagctgttgagcctggctacatcgtcaagcctcgcctgtacaacttcgctgaatacggtgtcccacaattccgcgaacgtgtgctcattgttggcattcgccgtgacaccggctttgatttcaagcacccagctcctacccatggccctcgcggtgacatgccgtataagactgccggcgaagcgctcaaaggcgtgaaggatgtccccacaaacaacaaccacatgaagatcatgcctcgcaccgttgaagtgcttaagcgcatccctgagggcgaaaacttcaccgcgatccccaaagatgacccctactacgtcaagggcatgattagtcacgtttaccgtcgcttgcaccgtgatgagccatccaaaacccttatcgccggtggcggcgggggtacatggggataccattatgaaaaaaatcgagcattgaccaaccgcgagcgggctagaattcaatcgttccccgatgactttgagtttttgggatcaaacaccgaagtccgccgccaaatcggtaatgctgttcctcctgtaggtatgcacgctgtgggtgagcgactgatgaacctgtacaccgggaattacactcccgtcgatctagaggaacagcacgcgtacctgcagacgctctccattaaggaacgtctcgcgctggctgatcaggaagctgattaagtagatatatgaagcccacc

SEQ ID NO: 162 - protein, 199 aa, Corynebacterium glutamicum
VLIVGIRRDTGFDFKHPAPTHGPRGDMPYKTAGEALKGVKDVPTNNNHMKIMPRTVEVLKRIPEGENFTAIPKDDPYYVKGMISHVYRRLHRDEPSKTLIAGGGGGTWGYHYEKNRALTNRERARIQSFPDDFEFLGSNTEVRRQIGNAVPPVGMHAVGERLMNLYTGNYTPVDLEEQHAYLQTLSIKERLALADQEAD

SEQ ID NO: 163 - DNA, 535 bp, Corynebacterium glutamicum
  CDS (101)..(535): FRXA01795
agaccatattgaagacctcgaagctgttgagcctggctacatcgtcaagcctcgcctgtacaacttcgctgaatacggtgtcccacaattccgcgaacgtgtgctcattgttggcattcgccgtgacaccggctttgatttcaagcacccagctcctacccatggccctcgcggtgacatgccgtataagactgccggcgaagcgctcaaaggcgtgaaggatgtccccacaaacaacaaccacatgaagatcatgcctcgcaccgttgaagtgcttaagcgcatccctgagggcgaaaacttcaccgcgatccccaaagatgacccctactacgtcaagggcatgattagtcacgtttaccgtcgcttgcaccgtgatgagccatccaaaacccttatcgccggtggcggcgggggtacatggggataccattatgaaaaaaatcgagcattgaccaaccgcgagcgggctagaattcaatcgttccccgatgactttgagtttttgggatcaaacacccaagtccgccgccaa

SEQ ID NO: 164 - protein, 145 aa, Corynebacterium glutamicum
VLIVGIRRDTGFDFKHPAPTHGPRGDMPYKTAGEALKGVKDVPTNNNHMKIMPRTVEVLKRIPEGENFTAIPKDDPYYVKGMISHVYRRLHRDEPSKTLIAGGGGGTWGYHYEKNRALTNRERARIQSFPDDFEFLGSNTQVRRQ

SEQ ID NO: 165 - DNA, 1614 bp, Corynebacterium glutamicum
  CDS (101)..(1591): RXA01214
gttgatatgatgtggggtgtttatgaaaatttgtttgagggagtgaaggcgcatgttgttgccagagttgaatcgtcggacttttttcaaaggggccggggtgctggcagcaacggtggtgggtgcgcaggtgctggtggcgtgttcctcagatgatgtgcgtggttatgggggagagccgcggacgttgcctattccaccagcagatttaggtacgcgtgagggatctagcgtgcactttgccctggaggctcagactggggagagtcagattttgccggatgtcacaacgaagacgtggggtttcaatggcactcatttggggccgacgttggtggtgaagaaaggtgatgacgtccacgttgatgtgataaacaatttggatgaaatgaccactgtgcactggcatggcatgaagttgccggcgattgctgatggtggtccgcactcaccgatcgggcctgggcagacgtggtcaccaacgtggactgtggccaatgatgcagccactttgtggtaccacccgcacactcatggcctgacaggtttgcatgcgtaccgtggtttggcggggatgatcattgtggaagatgaagcaacagacaagctggatctgccacgcgagtacggtgtggacgatattccgctggttttaatggatcaccgcttcttagaagacggttcccttgatgaggaagacctccccgatcttgggctgttgggcgatacccccactgccaatggcattaccaatgcgcactttgatgccaccacgcgccgggttcggttccgcgtgctcaacggctccaatatgcggttctataacttggcgttttcagacacgcgcaccttccaagtcattgccagcgattccggtttgctggatgaacctcaagaccgcaccaccttggctattggcccaggcgagcggtgggaaatcgtcgtggagctagagcccggcgaggacgtcaccttggaatctgtaggttttgaggacaactacggcgtccctgatgatgagttcgtgcccgatttcggcatgtcagattccttccagctgctcaccatcaccggcccttccgatgatgctgcgcaagcacctgctttgccgggcgtgctggtgaaatccaccgaacctgacgtcatcgatgccactgaacgcaccttcatcatgaacaccttctccatcaacgatctacagatggacatgcagcgcgttgacgtggtgattgaccatgaccagccagaagtgtggattgtcaccaacgacaactccgactggccccacaacttccatgtccacgacgcccggtttaaggtgctgaaatttgaaggcaccgacgtagagctcttcaacgacggctggaaagacaccgtcggcctgccaccgggagcaaccgcaactttagccgtggaatttggccactacccagacccgcaatggccctacatgtatcactgccacatgctctaccacgaggatcaaggcatgatggggcagttcgtcatcgtggagccaggcgacgagccggcggcggtgctggggtcgggcacgggctccagcattgactccgccggcggacatgcgcactaggggcgtggggcggcgtcgat

SEQ ID NO: 166 - protein, 497 aa, Corynebacterium glutamicum
VLAATVVGAQVLVACSSDDVRGYGGEPRTLPIPPADLGTREGSSVHFALEAQTGESQILPDVTTKTWGFNGTHLGPTLVVKKGDDVHVDVINNLDEMTTVHWHGMKLPAIADGGPHSPIGPGQTWSPTWTVANDAATLWYHPHTHGLTGLHAYRGLAGMIIVEDEATDKLDLPREYGVDDIPLVLMDHRFLEDGSLDEEDLPDLGLLGDTPTANGITNAHFDATTRRVRFRVLNGSNMRFYNLAFSDTRTFQVIASDSGLLDEPQDRTTLAIGPGERWEIVVELEPGEDVTLESVGFEDNYGVPDDEFVPDFGMSDSFQLLTITGPSDDAAQAPALPGVLVKSTEPDVIDATERTFIMNTFSINDLQMDMQRVDVVIDHDQPEVWIVTNDNSDWPHNFHVHDARFKVLKFEGTDVELFNDGWKDTVGLPPGATATLAVEFGHYPDPQWPYMYHCHMLYHEDQGMMGQFVIVEPGDEPAAVLGSGTGSSIDSAGGHAH

SEQ ID NO: 167 - DNA, 588 bp, Corynebacterium glutamicum
  CDS (1)..(588): RXA01250
ctggatatcggcggcatcgaagccaagacgtggggatacgtctctgacaccggggatgcggccattgaggccaccgccggcgacgtcctccaggtcgatatcaccaatgacctgcctgagagcacctccatccactggcatggcatcgcactccacaacgcagccgacggtgtgcccggcatgacccaggaccccattgaacctggcgagtctttctcctatgtttttgaagtcccccacggtggcacctacttctaccattcccacaccggcctgcagcttgatcgcggcctccacgccccactgatcatccgtgacccgcaagacgctgaggaccaggacgtcgagtggaccatcgtgctcgacgactgggtcgatggcattcagggcactcccgacgatgagctcgacaagctcaccggaatgggttcgggcgaccataacgggaggatgggaatgggaggtcacggccagatgatgcacggcaccccggaccgggtactgggcggggatgtcggcgatgtgatgtatccgcactacctcatcaacggacgtatcccccgtgctcaccggaccttcgaggctcgc

SEQ ID NO: 168 - protein, 196 aa, Corynebacterium glutamicum
LDIGGIEAKTWGYVSDTGDAAIEATAGDVLQVDITNDLPESTSIHWHGIALHNAADGVPGMTQDPIEPGESFSYVFEVPHGGTYFYHSHTGLQLDRGLHAPLIIRDPQDAEDQDVEWTIVLDDWVDGIQGTPDDELDKLTGMGSGDHNGRMGMGGHGQMMHGTPDRVLGGDVGDVMYPHYLINGRIPRAHRTFEAR

SEQ ID NO: 169 - DNA, 744 bp, Corynebacterium glutamicum
  CDS (101)..(721): RXA02477
cgagcagggctgtttgaaaagctgtaaatgacatgacctaaatgattgtactgactggcactttaggtcatatgtcacaccgagtggaataataaagcttatgcctttgcgtaatgttgatagaactccgcccgcagtatgggaagcattgcttgccggaaacgaaagattcatcagtttcaacgaagatcgaccaaaccaggacgccccgcgcagaagagaacttcgcaatggacaaacgcctgcagctgttgttatttcctgttcagattctcgagtgccagttgagattatttttgacgtcggtctcggtgacctctttgttgtccgtactgccggagaaatcctcgaccaagcagtgcttgcgtccatcgaatacgccactgaatccatcggcgttccattggttatcgtcatgggccacgaatcctgtggtgcagttgcagcaactgcagcagcacttgaaggcggtgcacttcccggaggctaccaacgagttttggttgaaaaggttgcaccatccattctagaagccaaggcagagggcctgagctccatcaaggaattcgaggaacaccacgttgtggcaacggtaaaccaactgttgtcccgttctccagagattcatcagaaggtcgaaaccggtgagttgggaatcattggtttgcgctaccgactctctgacggtcgtactgaacctgtaattagcaagaacgtgggttagttttcggtctgagattgcct

SEQ ID NO: 170 - protein, 207 aa, Corynebacterium glutamicum
MPLRNVDRTPPAVWEALLAGNERFISFNEDRPNQDAPRRRELRNGQTPAAVVISCSDSRVPVEIIFDVGLGDLFVVRTAGEILDQAVLASIEYATESIGVPLVIVMGHESCGAVAATAAALEGGALPGGYQRVLVEKVAPSILEAKAEGLSSIKEFEEHHVVATVNQLLSRSPEIHQKVETGELGIIGLRYRLSDGRTEPVISKNVG

SEQ ID NO: 171 - DNA, 618 bp, Corynebacterium glutamicum
  CDS (101)..(595): RXN00833
agctttttgcatgtgtcatatcgtaccgtttgcataggcctgttcgcgcttggtgaaccttttctagcaccaaaacaaaactctccctagtatggggtccatggctaaaacacattttcaaggcaacgaaactgctacctccggcgaactgccacaggtcggcgacaacctcgcagagttcaacctcgtcaacaccgaactgggcgaggtctcctcaaaggacttccagggccgcaagcttgtcctgaacatcttcccatccgttgacaccggcgtttgtgcaacatcagtccgcaagttcaacgaggcagcagcaagcctggaaaacaccaccgtgctgtgcatctccaaggatcttccattcgcactgggccgtttctgctccgcagaaggcatcgagaacgtcaccccagtatccgcattccgttccaccttcggtgaagacaacggcatcgtgctcgaaggctcaccacttaagggtcttcttgcacgcagcgtcatcgtcgtcgatgaaaacggcaaggttgcttacacccagttggttgatgagatcttcactgaacctgattacgacgctgcacttgctgggctgaactaatttacttcgctcaggggaat

SEQ ID NO: 172 - protein, 165 aa, Corynebacterium glutamicum
MAKTHFQGNETATSGELPQVGDNLAEFNLVNTELGEVSSKDFQGRKLVLNIFPSVDTGVCATSVRKFNEAAASLENTTVLCISKDLPFALGRFCSAEGIENVTPVSAFRSTFGEDNGIVLEGSPLKGLLARSVIVVDENGKVAYTQLVDEIFTEPDYDAALAGLN

SEQ ID NO: 173 - DNA, 469 bp, Corynebacterium glutamicum
  CDS (101)..(469): FRXA00833
agctttttgcatgtgtcatatcgtaccgtttgcataggcctgttcgcgcttggtgaaccttttctagcaccaaaacaaaactctccctagtatggggtccatggctaaaacacattttcaaggcaacgaaactgctacctccggcgaactgccacaggtcggcgacaacctcgcagagttcaacctcgtcaacaccgaactgggcgaggtctcctcaaaggacttccagggccgcaagcttgtcctgaacatcttcccatccgttgacaccggcgtttgtgcaacatcagtccgcaagttcaacgaggcagcagcaagcctggaaaacaccaccgtgctgtgcatctccaaggatcttccattcgcactgggccgtttctgctccgcagaaggcatcgagaacgtcaccccagtatccgcattccgttccaccttcggtgaagacaacggcatcgtgctcgaaggctca

SEQ ID NO: 174 - protein, 123 aa, Corynebacterium glutamicum
MAKTHFQGNETATSGELPQVGDNLAEFNLVNTELGEVSSKDFQGRKLVLNIFPSVDTGVCATSVRKFNEAAASLENTTVLCISKDLPFALGRFCSAEGIENVTPVSAFRSTFGEDNGIVLEGS

SEQ ID NO: 175 - DNA, 1146 bp, Corynebacterium glutamicum
  CDS (101)..(1123): RXA01224
ttggcggcgggaagttcaggcttgggggcaaacagtgcttggattttagacaaaaaactcacggaagtcatcctatggcaggcgcgcctaggatggtgccatgagcatccttgacacgttgaaaactcccgtgattgtcgccccgatggctggcggcccgtccactcccgcgttggtcaatgcagcagcagaggcaggttccctcgggttcttggctggtggcgtcatgcctcttgagcagctgaaacaggaattgtcagaggtaaaaggcgtctttggcgtcaacctgtttcgcccgcagacggatgcgcctaagccttcagacattgatgagctggcgggattgttgtcctcggcgtttcggcaatttggcctcgatgagccgacggtgcctacgccggatttgagcaatgggtgggaggctaaatttgaggccgttcttgccgctaagcccgccgttttttcctgcacctttggtatttttagcgctgaagaattcgcccggatcaaagccaccggaattgaggcgtgggtgacggtgaccaatccggaggacgcgctggctgcgcagaaagctggcgccaacgcgcttgtcgtgcaaggccccgaggcgggtgggcaccgctctacctggtccattgaagtggagccggacgagcgcgacctgaaaaccctcctcgcagctgtcaaacaagcgggcgtttacctcccgctcatcgcagccggcggcctttcaacctccgcagacgtggcagcaattttagaagccggcgccagcgctgcctcctgtggttccgcctttttgcttagcgacgaagccggcaccagctcacttaaccgcgagatcttggacgccgccccagcacttggtttggaatcggtgtcatctcgcgcattttcgggccgttatgccaggggagtggaaaccaggttcacccgttcgaacgaggggttacccccgttgtacccatacctcaacccaatgatcacatctttacgtaaggtggcgggaagtgcagggaactgggattacgcctactgcctggtaggagtcggcctggaatcgattgcgaagggtagtgcaaagcagatactggaatcattaacaccttccgctttgggctaatgttggggggagtgctttca

SEQ ID NO: 176 - protein, 341 aa, Corynebacterium glutamicum
MSILDTLKTPVIVAPMAGGPSTPALVNAAAEAGSLGFLAGGVMPLEQLKQELSEVKGVFGVNLFRPQTDAPKPSDIDELAGLLSSAFRQFGLDEPTVPTPDLSNGWEAKFEAVLAAKPAVFSCTFGIFSAEEFARIKATGIEAWVTVTNPEDALAAQKAGANALVVQGPEAGGHRSTWSIEVEPDERDLKTLLAAVKQAGVYLPLIAAGGLSTSADVAAILEAGASAASCGSAFLLSDEAGTSSLNREILDAAPALGLESVSSRAFSGRYARGVETRFTRSNEGLPPLYPYLNPMITSLRKVAGSAGNWDYAYCLVGVGLESIAKGSAKQILESLTPSALG

SEQ ID NO: 177 - DNA, 516 bp, Corynebacterium glutamicum
  CDS (101)..(493): RXA01182
gttaaaacggaaactaataccccaaaggataccgattcaatttgtgatgtgtggtgttcgggtcatatcaagctaaacagatgccccctacaataggcttgtgttcaatttatttggtcgtaaaactcctcgctctaacctccgcccaccacgcggtccgggcgatactgtgcgcccggaagatttaaaattcttgatgcaatgggtgcaggataagccatttgttgaggcattcgttgaaccggaaacgctggtcaatgagatgtctgtcgttttggttgatgctcatggggtttttgtccgccgaaggatcggcggtcccaaagggattgatgttatcgcgaaaaagctcggcgttccggtttatgatgttgaggagaccggttacccccaaaggatgcgcgaacgcattgaatatgagcgcatcttaagaaagcgtgaggaacaaaaagctcgccgcgctaaatttgagcgcggcgagaatcctgatctttaactagcgtttagctttccgac

SEQ ID NO: 178 - protein, 131 aa, Corynebacterium glutamicum
VFNLFGRKTPRSNLRPPRGPGDTVRPEDLKFLMQWVQDKPFVEAFVEPETLVNEMSVVLVDAHGVFVRRRIGGPKGIDVIAKKLGVPVYDVEETGYPQRMRERIEYERILRKREEQKARRAKFERGENPDL

SEQ ID NO: 179 - DNA, 834 bp, Corynebacterium glutamicum
  CDS (101)..(811): RXA02531
cacttcgctccccaaggtacatccccgatgccacttcttggagccatcatcggtgccaccaaacacattgaagtgggcactggagtagtggatatgcgttatgaaaatccctttgtatatggccgaggaagcagctgctctcaatctgcttgccgacggccgactagccctcggagtttccaggggatcacccgaaccagccgagaagggttgggaagctttcggctacgacggcggtgatgatcctaaagctgcaggcatggcacgggagaaattccttcgcttcctcgatgccatcgatggtcgccccatgtccatcgcttccgagaatcaatacccacgcctctaccatccgggcactcccctgccgatcttcccgcatgatcttgacttgggtaaatccatttggtggggcgccggttcccacaacaccgccgaacaagcagcacgcgatggcgttaacttgatgagctccaccctcgtcgccgaagccaccggccaatccttcggggatctgcaagccgatcaaatcgcgttctaccgccaagcttggaaagaagccggacacgattggaccccacgtgtgtctgtctccaggtccatctttccgatcgtcaccgaccgcgaccgtgagcttttcggacttcagggacaaggcggtgaccaagtaggaatcctggatgatacccgatccacgttcggtcgcagctacgccggaagtcccgatgaactcatcgaccagctccaaggaagacaaagctgtgatggaagccgacaccttgatgctcaccgcccccaaccaaatgggtgttgagatcaacgcgtcgatcctga

SEQ ID NO: 180 - protein, 237 aa, Corynebacterium glutamicum
MKIPLYMAEEAAALNLLADGRLALGVSRGSPEPAEKGWEAFGYDGGDDPKAAGMAREKFLRFLDAIDGRPMSIASENQYPRLYHPGTPLPIFPHDLDLGKSIWWGAGSHNTAEQAARDGVNLMSSTLVAEATGQSFGDLQADQIAFYRQAWKEAGHDWTPRVSVSRSIFPIVTDRDRELFGLQGQGGDQVGILDDTRSTFGRSYAGSPDELIDQLQGRQSCDGSRHLDAHRPQPNGC

SEQ ID NO: 181 - DNA, 1614 bp, Corynebacterium glutamicum
  CDS (101)..(1591): RXN00689
acagggaaatcctcccagaattaatcaccgaagctgcacaccagatggctactgcagacctcaatcgtgcaaaggccctgttaagaacggatgcgatccgatgaatgctgcaaccaggcgtgcttctctgcaactcccctatacccatgtcgatgatttctacatcaacggttcctgggttaaagcagaaggaacacaacgcaaccccgtagttgatcctgcggtcggtcaagaatggggatctgttccagaagcaaccgcatctgaattggactctgcggtgggagctgcacgtacagcgctaaagtcgtggagtgcacttacaggtgcggaacgaacaggctacctcctgaaaatcgcgacggaaattgaatcccgttctgaagctctagcacttactaatacccgcgaaaatggttcccccatttccgagacccgtggagctgcgtccaatgcagcaggaattttccgttactttgccactctcgcgccttggttagacggcgaagacatccgcccatttcctgccggtagcgccgaatccatcgtggataaagatcccatcggtgtctgcgcactcatcgccccatggaatttcccgatcaaccttgtagtcatcaaactggcaccagcacttcttgccggctgtaccgtcatcatcaaaccagcctcccccaccccactgtcgatccgtttcatcatcgaagccatcgaagccgccggagtgccagcaggcgtagtcaacctactcaccggttcagggcgtttcggtgatgcccttgtccgccaccccggagtagacaaggtagcgtttaccggatcaacgcctgttggaaagaagatcgctgccgcctgcggagaactactccgaccagtgactttagagctaggcggaaaatcttccgcgattatccttcctgatgcagacatgtcagtactctcgacgcggttgattcgatcctgtatgcgcaacactggacaaacctgctacatcagtacccggattattgcccctagctcacgctatgcggaagtcgtacaaacagtggcaagcactatcgctgcaggtagacaaggtgacccctatgatgaagaaacggtttttgggccagttgccagcgcctctcagtactcaaccgtcatgtcttacattgactccgcacgagaggaaggtgcacgagtggttgcaggtggaacccggtcaatcagcctttctgaaggtttagaatcaggcgagtttatccaaccaaccgtgtttgccgatgtcacccccgacatgcggatatcacgcgaagaaatcttcggccctgttatttccatcctaaagtacgacgatacaaacggtgtttccgaagcaatcgcactagccaacaacacgaaattcggtctcggtggcttggtatttggtgcggatgaggaacaagcactagaagtcgcccgtcaagtggattctggttccgtaggcatcaacttcttcggttccaaccattccgccccatttggaggacgccacgaatccggtatgggagtggaatacggcatcgaaggcctcagtgcttacctgacatacaagagtattcaccgaaccatttagttactgaaagttctcagcta

SEQ ID NO: 182 - protein, 497 aa, Corynebacterium glutamicum
MNAATRRASLQLPYTHVDDFYINGSWVKAEGTQRNPVVDPAVGQEWGSVPEATASELDSAVGAARTALKSWSALTGAERTGYLLKIATEIESRSEALALTNTRENGSPISETRGAASNAAGIFRYFATLAPWLDGEDIRPFPAGSAESIVDKDPIGVCALIAPWNFPINLVVIKLAPALLAGCTVIIKPASPTPLSIRFIIEAIEAAGVPAGVVNLLTGSGRFGDALVRHPGVDKVAFTGSTPVGKKIAAACGELLRPVTLELGGKSSAIILPDADMSVLSTRLIRSCMRNTGQTCYISTRIIAPSSRYAEVVQTVASTIAAGRQGDPYDEETVFGPVASASQYSTVMSYIDSAREEGARVVAGGTRSISLSEGLESGEFIQPTVFADVTPDMRISREEIFGPVISILKYDDTNGVSEAIALANNTKFGLGGLVFGADEEQALEVARQVDSGSVGINFFGSNHSAPFGGRHESGMGVEYGIEGLSAYLTYKSIHRTI

SEQ ID NO: 183 - DNA, 750 bp, Corynebacterium glutamicum
  CDS (101)..(727): FRXA00689
actccgaccagtgactttagagctaggcggaaaatcttccgcgattatccttcctgatgcagacatgtcagtactctcgacgcggttgattcgatcctgtatgcgcaacactggacaaacctgctacatcagtacccggattattgcccctagctcacgctatgcggaagtcgtacaaacagtggcaagcactatcgctgcaggtagacaaggtgacccctatgatgaagaaacggtttttgggccagttgccagcgcctctcagtactcaaccgtcatgtcttacattgactccgcacgagaggaaggtgcacgagtggttgcaggtggaacccggtcaatcagcctttctgaaggtttagaatcaggcgagtttatccaaccaaccgtgtttgccgatgtcacccccgacatgcggatatcacgcgaagaaatcttcggccctgttatttccatcctaaagtacgacgatacaaacggtgtttccgaagcaatcgcactagccaacaacacgaaattcggtctcggtggcttggtatttggtgcggatgaggaacaagcactagaagtcgcccgtcaagtggattctggttccgtaggcatcaacttcttcggttccaaccattccgccccatttggaggacgccacgaatccggtatgggagtggaatacggcatcgaaggcctcagtgcttacctgacatacaagagtattcaccgaaccatttagttactgaaagttctcagcta

SEQ ID NO: 184 - protein, 209 aa, Corynebacterium glutamicum
MRNTGQTCYISTRIIAPSSRYAEVVQTVASTIAAGRQGDPYDEETVFGPVASASQYSTVMSYIDSAREEGARVVAGGTRSISLSEGLESGEFIQPTVFADVTPDMRISREEIFGPVISILKYDDTNGVSEAIALANNTKFGLGGLVFGADEEQALEVARQVDSGSVGINFFGSNHSAPFGGRHESGMGVEYGIEGLSAYLTYKSIHRTI

SEQ ID NO: 185 - DNA, 878 bp, Corynebacterium glutamicum
  CDS (1)..(855): RXN03128
aacggactcgccattcccgacattggatttggtgtattccaaaccccacccgatgaaacccgaaactccgttaacgctgctcttgaagccggctatcgccacatcgacaccgccgccgcatacggcaatgaacgtgaagtcggtgaagcaatcgcagcatccggcattggccgcgacgagatcaccatcgaaaccaaaatctgggtgaccgactacggcttcgaggaaactctccacgcattcgacaaggccacaggcaagcttggtgtcgatacactggacattttgatcttgcaccaggcagtgccaagcagctttgatcgcaccatcgccgcctacaaggcgctagagaagctgcttttcgacggcgcggtgcgggcaatcggagtcagtaatttcatgccagagcacctggacaaactccttttggaaacctccattgtcccagctctgaaccaaatcgaatgccacccctacttccagcagcgtgacgtgcttgcccgcaatgagcagcttggcattttgactcaggcgtggtcaccaatcggtggcatcaccttctaccgcgacggacagcttccaagcactctagaaaatgaggtcatcgctggaatcgccgcagaagttggcaaaacaccagctcaagtaatgctgcgctggcacctacagcgtagacgtcacgcaattccaaagtctgtgaccccatcacgcattgtggaaaactttgagatctttgatttcgaactctccgatgagcaactacagcaaatcgatgccctcaacaccgatctgcgcggtggcccagaaccagagaacatcaccatggaaaactactaccgagaaatcccagaagcctaaaggcccttagaggcgaatgt

SEQ ID NO: 186 - protein, 285 aa, Corynebacterium glutamicum
NGLAIPDIGFGVFQTPPDETRNSVNAALEAGYRHIDTAAAYGNEREVGEAIAASGIGRDEITIETKIWVTDYGFEETLHAFDKATGKLGVDTLDILILHQAVPSSFDRTIAAYKALEKLLFDGAVRAIGVSNFMPEHLDKLLLETSIVPALNQIECHPYFQQRDVLARNEQLGILTQAWSPIGGITFYRDGQLPSTLENEVIAGIAAEVGKTPAQVMLRWHLQRRRHAIPKSVTPSRIVENFEIFDFELSDEQLQQIDALNTDLRGGPEPENITMENYYREIPEA

SEQ ID NO: 187 - DNA, 522 bp, Corynebacterium glutamicum
  CDS (1)..(522): FRXA02192
attcccgacattggatttggtgtcttccaaaccccacccgatgaaacccgaaactccgttaacgctgctcttgaagccggctatcgccacatcgacaccgcggccgcatacggcaatgaacgtgaagtcggtgaagcaatcgcagcatccggcattggccgcgacgagatcaccatcgaaaccaaaatctgggtgaccgactacggcttcgaggaaactctccacgcattcgacaaggccacaggcaagcttggtgtcgatacactggacattttgatcttgcaccaggcagtgccaagcagctttgatcgcaccatcgccgcctacaaggcgctagagaagctgcttttcgacggcgcggtgcgggcaatcggagtcagtaatttcatgccagagcacctggacaaactccttttggaaacctccattgtcccagctctgaaccaaatcgaatgccacccctacttccagcagcgtgacgtgcttgcccgcaatgagcagcttggcattttgactcaggcg

SEQ ID NO: 188 - protein, 174 aa, Corynebacterium glutamicum
IPDIGFGVFQTPPDETRNSVNAALEAGYRHIDTAAAYGNEREVGEAIAASGIGRDEITIETKIWVTDYGFEETLHAFDKATGKLGVDTLDILILHQAVPSSFDRTIAAYKALEKLLFDGAVRAIGVSNFMPEHLDKLLLETSIVPALNQIECHPYFQQRDVLARNEQLGILTQA

SEQ ID NO: 189 - DNA, 1039 bp, Corynebacterium glutamicum
  CDS (101)..(1039): RXA02351
tgacactttacagactggttttcaactaatgacaccgaaagaaatacacctcaacctttttgctttcggtgccgggcaccacgcggcggcgtggcgagcggtggagggaagcgtcgaaaagctgggtttaatttcctggtgggaggaactcgcgcgcaccgctgagcggggcaagctggatgcggtctttttggccgatgggcaggcgattaatccggtcggtctggagaatgggccgggctggtttttggagccggtgaccgcgttgactgcgatggcgcgggcgacgaacaatattgggttgatcagcacaatttccagtacgttttggcagccgtttcatgcggcgcggatgatcgccagcttggatcatatttcgggtgggcgtgctggaatcaatgtggtgacatcgatgaccgatgcggaggcgcgtaaccacgggatggatgcgttgccgggtcacgatgttcgctatgcgcgcgctgcggaatttattgaaaccatcactgcgctgtgggattcttggcctgcggaaagtttggtgatggatcgtgctggaaaatttgcggactcctcgctcattaaatctatcgatcatgatggtgagttcttccaagtcgctggtccgctgaatatccccagtcctccgcagggtcgacccgtactttttcaggctggatcctcaccgcaaggacgggaaatcgctgcgaaatacgccgaggcaatttactctgtggcgtgggatttggagcaagcgcaagattatcgctctgatattcatgctcgtgccactgcccagggtcgcgagcccatgccggtgcttcctggtttggtgacttttgttggcacgaccgtggaagaagcgcgtgcaaaacagcaggctcttaatgcgttgctgccggtcaaagactcactaaatcagttgagtttctttgtgggtcaagattgctcgacgtgggatttggatgcacctcccccaccactgccaccgctagaagagttttccggtcctaaaggcaggtacgaaacggtcctgcgg

SEQ ID NO: 190 - protein, 313 aa, Corynebacterium glutamicum
VEGSVEKLGLISWWEELARTAERGKLDAVFLADGQAINPVGLENGPGWFLEPVTALTAMARATNNIGLISTISSTFWQPFHAARMIASLDHISGGRAGINVVTSMTDAEARNHGMDALPGHDVRYARAAEFIETITALWDSWPAESLVMDRAGKFADSSLIKSIDHDGEFFQVAGPLNIPSPPQGRPVLFQAGSSPQGREIAAKYAEAIYSVAWDLEQAQDYRSDIHARATAQGREPMPVLPGLVTFVGTTVEEARAKQQALNALLPVKDSLNQLSFFVGQDCSTWDLDAPPPPLPPLEEFSGPKGRYETVLR

SEQ ID NO: 191 - DNA, 924 bp, Corynebacterium glutamicum
  CDS (101)..(901): RXN00905
cgctgcccctctatgctgctcctagttacccctgcacaaatagcggtttttctcacgcattctgcatcgagtcgggtcgacgtatataaggtggaaaggcatgacccaattcgaaaacgcgcaagtacttaaagagaacatcgaaaaccaacgcgagcagatctttacccagttgaaagaaattgtgtctttcaactccgtgcacagcgatccaaacctactggaggactacgccggcgcgaaagaatgggtaaaagaaacactgaccaacgcaggtctcaccgtcagcgaattcgctgccgaagatggaaccaccaacttcatcggcacccgcaagggctccgaaggtgcaccaaaggtactgctgtacagccacttcgacgttgtcccatccggccctttggatctctgggacaccaatccttttgaactcaccgagcgcgacgctggccacggcacccgctggtacggccgcggcgccgctgactgcaagggcaacctggtcatgcacctcgcagcactgcgcgccgtcgaagccagcggcgacaccacactcaacctcacctacgtggtcgagggctccgaggaaatgggaggcggagcgctcagcgcgctcatcaaggacaagcctgagcttttcgacgcagatgtcatcttgattgcagacagcggaaacgcttccgtgggcaccccaaccttgaccactaccctgcgcggtggcggacaggtcaccgtcaccgtggacacccttgaaggcgctgttcactccggccagaacggtggcgctgccccagatgctgttgctgctctcgtgcgcgttctggatactttgcgcgatgaacacggacgcaccgttatcgacggctgtcaacaccaccgcaaactggaagggcgagccttatgatccagagactttccgcagcg

SEQ ID NO: 192 - protein, 267 aa, Corynebacterium glutamicum
MTQFENAQVLKENIENQREQIFTQLKEIVSFNSVHSDPNLLEDYAGAKEWVKETLTNAGLTVSEFAAEDGTTNFIGTRKGSEGAPKVLLYSHFDVVPSGPLDLWDTNPFELTERDAGHGTRWYGRGAADCKGNLVMHLAALRAVEASGDTTLNLTYVVEGSEEMGGGALSALIKDKPELFDADVILIADSGNASVGTPTLTTTLRGGGQVTVTVDTLEGAVHSGQNGGAAPDAVAALVRVLDTLRDEHGRTVIDGCQHHRKLEGRAL

SEQ ID NO: 193 - DNA, 716 bp, Corynebacterium glutamicum
  CDS (1)..(693): FRXA00905
gatccaaacctactggaggactacgccggcgcgaaagaatgggtaaaagaaacactgaccaacgcaggtctcaccgtcagcgaattcgctgccgaagatggaaccaccaacttcatcggcacccgcaagggctccgaaggtgcaccaaaggtactgctgtacagccacttcgacgttgtcccatccggccctttggatctctgggacaccaatccttttgaactcaccgagcgcgacgctggccacggcacccgctggtacggccgcggcgccgctgactgcaagggcaacctggtcatgcacctcgcagcactgcgcgccgtcgaagccagcggcgacaccacactcaacctcacctacgtggtcgagggctccgaggaaatgggaggcggagcgctcagcgcgctcatcaaggacaagcctgagcttttcgacgcagatgtcatcttgattgcagacagcggaaacgcttccgtgggcaccccaaccttgaccactaccctgcgcggtggcggacaggtcaccgtcaccgtggacacccttgaaggcgctgttcactccggccagaacggtggcgctgccccagatgctgttgctgctctcgtgcgcgttctggatactttgcgcgatgaacacggacgcaccgttatcgacggctgtcaacaccaccgcaaactggaagggcgagccttatgatccagagactttccgcagcg

SEQ ID NO: 194 - protein, 231 aa, Corynebacterium glutamicum
DPNLLEDYAGAKEWVKETLTNAGLTVSEFAAEDGTTNFIGTRKGSEGAPKVLLYSHFDVVPSGPLDLWDTNPFELTERDAGHGTRWYGRGAADCKGNLVMHLAALRAVEASGDTTLNLTYVVEGSEEMGGGALSALIKDKPELFDADVILIADSGNASVGTPTLTTTLRGGGQVTVTVDTLEGAVHSGQNGGAAPDAVAALVRVLDTLRDEHGRTVIDGCQHHRKLEGRAL

SEQ ID NO: 195 - DNA, 627 bp, Corynebacterium glutamicum
  CDS (101)..(604): RXA00906
accgtggacacccttgaaggcgctgttcactccggccagaacggtggcgctgccccagatgctgttgctgctctcgtgcgcgttctggatactttgcgcgatgaacacggacgcaccgttatcgacggctgtcaacaccaccgcaaactggaagggcgagccttatgatccagagactttccgcagcgatgccggcatcctcgacggtgtagacatcatgggcgacggcgacaacccagcaagcatgctgtggtccaggcctgcaatctccatcaccggattcacttccaccccagtggcagaagcactcaacgcagtgcccgcaacggcgtccgccaagctaaaccttcgcgtgccagcaggcctggaagcaaacgatgtggccgagaagctgaagcagcacctgatcaatcacacaccttggggcgcaaagatcacggtggagatcgatgacattaaccaaccgttctccaccgatattaccggccctgcaatgtccaccctggcgtcctgcctgagcgctgcgtacgagggcaaggatcttgtcaccgaaggcagcggcggatccattccactgtgtaccgaactgattgaggtcaacccataagcagaattggcactctacgg

SEQ ID NO: 196 - protein, 168 aa, Corynebacterium glutamicum
MNTDAPLSTAVNTTANWKGEPYDPETFRSDAGILDGVDIMGDGDNPASMLWSRPAISITGFTSTPVAEALNAVPATASAKLNLRVPAGLEANDVAEKLKQHLINHTPWGAKITVEIDDINQPFSTDITGPAMSTLASCLSAAYEGKDLVTEGSGGSIPLCTELIEVNP

SEQ ID NO: 197 - DNA, 246 bp, Corynebacterium glutamicum
  CDS (101)..(223): RXA00907
cctgagcgctgcgtacgagggcaaggatcttgtcaccgaaggcagcggcggatccattccactgtgtaccgaactgattgaggtcaacccataagcagaattggcactctacggtgtggaagaacccctcaccgttatccactccgctaatgaatctgttgaccccaatgagattcgcgatatcgccaccgcagaagcattgttcctgctcaactacaccaagtagacccaaaagcaggcgttaac

SEQ ID NO: 198 - protein, 41 aa, Corynebacterium glutamicum
LALYGVEEPLTVIHSANESVDPNEIRDIATAEALFLLNYTK

SEQ ID NO: 199 - DNA, 1386 bp, Corynebacterium glutamicum
  CDS (101)..(1363): RXA02101
gccatggaatgctccgttgaacgcaacagccttaaatacaatcccctcctataagccaagagttttagtgtcgctgcgcaggtactctactatctaatccatgagccgcatttcagaacttctaaacaatcatggtgttgatctgtcgtggcaagaggccgcatatcaggatttccacgaacatcctgagctctccggcttcgaatcagagaccgcagatcgcattcagaaatacctcgagcgttttgattgtgaggtgattccaaatgttggcggttacggcattctggccgtgttccgaaatgggtcgacagatcctggtgcccctgttgcgttaatgcgcgcagatttcgatggccttcccgtcaaggaaatcaccggagttccgtttgcttccactcgtatgcgtccgcatgatggggcaaatgtccatgtcatgcacgcatgcggccacgatgtccacgtcaccgcgctgcttggtgcgtgtgccattttagatgagcgtcgcgatgcatgggaaggcacgttcatcgcgttgttccagccatcggaggaaaactcccaaggcgctaacaagatggtcgccggcggtttagttgatctgatcccacgccctgatgtgtgctttggccagcatgtagtccccggtgctgcaggaaccgtgatgagcatgcctggcggtgctctcgctgcctgcgattccattgaaatccgcattcagggtcgcagcgcccatggttccatgcctcataattccatcgatcccacttatgttgcagcgatgattgtcgtgcgactccaaggaatcgtgggccgcgaggtttctccagaggatttcgccgttatttctgtgggcaccctccagtcgggcaacaccaacaacaccattccagcaagtgctcgtttggtgttgaactgccgtttctacaacgacaaagtcaagcacaaggtctaccgagccatcgaacgtgttgtccgtggtgaatgccttgcttccggtattgaggaagaacctgtcattgagtacttcgcccacggtgatctcaccaacaacacccctgttgtcttcgatactgtgcgccctgtcttcgacgatgttttcggcgaggattctattgacgcttaccggtggactgcgtcggaggatttcccctccattcctaaggcattcaacagcccttacctgtactggacgattggtgtcacgccgcgcgatcagtggacagaagccgtagaaagagaccgcgtggcatcggatgtgccagccaatcacatgggagatttcctccctgattatgcgccgacgatgtccgctgccacccgcgcagccgcagccgcgctgctgacctacttgggaactaactaatcatctagttttctgcgacg

SEQ ID NO: 200 - protein, 421 aa, Corynebacterium glutamicum
MSRISELLNNHGVDLSWQEAAYQDFHEHPELSGFESETADRIQKYLERFDCEVIPNVGGYGILAVFRNGSTDPGAPVALMRADFDGLPVKEITGVPFASTRMRPHDGANVHVMHACGHDVHVTALLGACAILDERRDAWEGTFIALFQPSEENSQGANKMVAGGLVDLIPRPDVCFGQHVVPGAAGTVMSMPGGALAACDSIEIRIQGRSAHGSMPHNSIDPTYVAAMIVVRLQGIVGREVSPEDFAVISVGTLQSGNTNNTIPASARLVLNCRFYNDKVKHKVYRAIERVVRGECLASGIEEEPVIEYFAHGDLTNNTPVVFDTVRPVFDDVFGEDSIDAYRWTASEDFPSIPKAFNSPYLYWTIGVTPRDQWTEAVERDRVASDVPANHMGDFLPDYAPTMSAATRAAAAALLTYLGTN

SEQ ID NO: 201 - DNA, 1389 bp, Corynebacterium glutamicum
  CDS (101)..(1366): RXN02565
ggaaattcgatacagtgcgatgacgcgatattagaaagaaaaagatgcgctttacgacgaaaccctcaccctccttcaggaacttatccgcaacgcctgcgtgaatgatctaaccccagattcaggtcaggaaattagaaacgcggaaagcctagaacgtttctttgaaggaacccccaacgttaaaatcaccaagctggaaccgcatccgggccggacctcaattatcgtgactgttccaggcagcgatccagatgctgagcctttaacactgcttggacatactgatgttgtgcctgttgatctgcctaaatggactaaagatccattcggtgcggagatttcggatggacagatttggggtagagggtccgtcgatatgctctttattaccgcaacccaagcggccgtcacccgtcaagtagcccgtgaaggcggcctgcgtggcacgctgacattcgttggcgttgctgatgaggaagcccgcggcggactcggagcgaagtggctttccgaagaacaccaaaacctcttcagctggaaaaactgcctctccgaatccggtggatcgcaccttccagtccacgacggcagcgacgcagtagtaattaacgttggagaaaaaggtgcagctcaacgtcgtattcacgtcaatggcgatgctggtcatggttccattcctttcgaccgtgacagcgctattgtcaagatcggtgaagtcgcccgccgaatcgctgccgccgatctgaaggtagccaaggacgatatctggcaaggcttcgtccaagcgcaccgtttcgacccagaaacggagcaggcgcttcttagcgggacctcccctgaggcctacgcagagttcggcggactctcccgcttcgcccacgcggtgtctcatctcacgatcgcccaaactgtggttcgtgcaggtcaagccatcaatgtattgccatcgcatgcgtacttggaactggatatccgtacccttccaggccaaaccaatgactatgttgatgacaccctgcgtgctgctctgggcgatcttgccgatgaagtagaaatcgaacacctcatctctgaagaagcaacggtgagcccaactgattccaggttgtataacaccttggaaaaagttcttggtgatttcttccccgatgcgcctgtggtcccaattatttcctctggtggctctgacctgcgctttggtcgtcgactaggcggtgttggttatggttttgcagttcatgcacgtgaacgaactttggcggaagcaatggggcaacttcactcccatgacgaggcgctgtacctggaagatcttgaactgactgttcggggttatgactccgtcgtgcgtgaattcctaggctaaaaacatgaagcaggagtctt

SEQ ID NO: 202 - protein, 422 aa, Corynebacterium glutamicum
VNDLTPDSGQEIRNAESLERFFEGTPNVKITKLEPHPGRTSIIVTVPGSDPDAEPLTLLGHTDVVPVDLPKWTKDPFGAEISDGQIWGRGSVDMLFITATQAAVTRQVAREGGLRGTLTFVGVADEEARGGLGAKWLSEEHQNLFSWKNCLSESGGSHLPVHDGSDAVVINVGEKGAAQRRIHVNGDAGHGSIPFDRDSAIVKIGEVARRIAAADLKVAKDDIWQGFVQAHRFDPETEQALLSGTSPEAYAEFGGLSRFAHAVSHLTIAQTVVRAGQAINVLPSHAYLELDIRTLPGQTNDYVDDTLRAALGDLADEVEIEHLISEEATVSPTDSRLYNTLEKVLGDFFPDAPVVPIISSGGSDLRFGRRLGGVGYGFAVHARERTLAEAMGQLHSHDEALYLEDLELTVRGYDSVVREFLG

SEQ ID NO: 203 - DNA, 365 bp, Corynebacterium glutamicum
  CDS (1)..(342): FRXA02565
gctgctctgggcgatcttgccgatgaagtagaaatcgaacacctcatctctgaagaagcaacggtgagcccaactgattccaggttgtataacaccttggaaaaagttcttggtgatttcttccccgatgcgcctgtggtcccaattatttcctctggtggctctgacctgcgctttggtcgtcgactaggcggtgttggttatggttttgcagttcatgcacgtgaacgaactttggcggaagcaatggggcaacttcactcccatgacgaggcgctgtacctggaagatcttgaactgactgttcggggttatgactccgtcgtgcgtgaattcctaggctaaaaacatgaagcaggagtctt

SEQ ID NO: 204 - protein, 114 aa, Corynebacterium glutamicum
AALGDLADEVEIEHLISEEATVSPTDSRLYNTLEKVLGDFFPDAPVVPIISSGGSDLRFGRRLGGVGYGFAVHARERTLAEAMGQLHSHDEALYLEDLELTVRGYDSVVREFLG

SEQ ID NO: 205 - DNA, 738 bp, Corynebacterium glutamicum
  CDS (1)..(738): FRXA02567
cttatccgcaacgcctgcgtgaatgatctaaccccagattcaggtcaggaaattagaaacgcggaaagcctagaacgtttctttgaaggaacccccaacgttaaaatcaccaagctggaaccgcatccgggccggacctcaattatcgtgactgttccaggcagcgatccagatgctgagcctttaacactgcttggacatactgatgttgtgcctgttgatctgcctaaatggactaaagatccattcggtgcggagatttcggatggacagatttggggtagagggtccgtcgatatgctctttattaccgcaacccaagcggccgtcacccgtcaagtagcccgtgaaggcggcctgcgtggcacgctgacattcgttggcgttgctgatgaggaagcccgcggcggactcggagcgaagtggctttccgaagaacaccaaaacctcttcagctggaaaaactgcctctccgaatccggtggatcgcaccttccagtccacgacggcagcgacgcagtagtaattaacgttggagaaaaaggtgcagctcaacgtcgtattcacgtcaatggcgatgctggtcatggttccattcctttcgaccgtgacagcgctattgtcaagatcggtgaagtcgcccgccgaatcgctgccgccgatctgaaggtagccaaggacgatatctggcaaggcttcgtccaagcgcaccgtttcgacccagaaacggagcaggcg

SEQ ID NO: 206 - protein, 246 aa, Corynebacterium glutamicum
LIRNACVNDLTPDSGQEIRNAESLERFFEGTPNVKITKLEPHPGRTSIIVTVPGSDPDAEPLTLLGHTDVVPVDLPKWTKDPFGAEISDGQIWGRGSVDMLFITATQAAVTRQVAREGGLRGTLTFVGVADEEARGGLGAKWLSEEHQNLFSWKNCLSESGGSHLPVHDGSDAVVINVGEKGAAQRRIHVNGDAGHGSIPFDRDSAIVKIGEVARRIAAADLKVAKDDIWQGFVQAHRFDPETEQA

SEQ ID NO: 207 - DNA, 1308 bp, Corynebacterium glutamicum
  CDS (101)..(1285): RXN03077
accccgatcctttgttttcgtgggatcactattagactcgactctaccgcgctgcaggttttcctgatacgcctgcggacaaaacagaaaggtatttcacgtgatggaaattggtgtgcaggttgcctcatggatggaccgccaccatgacgaggtcataaagtggcgcaggcatttgcacagccatcctgagctctcccacatggaataccgcacgactgagtatttggcctcggttctgaaagatcacggcatggaaccacacctgttcccaggaaccggtttgatggtggatatcggaccagaaggggactcccgcctggcgtttcgcgctgatatcgatgcccttccgctgcttgaatcaaccggcttagagttctcttccacagccactggcgttgcgcatgcctgcggacatgacgtgcacacggtgatcgctttggcacttgcctgtgcactgaacaccatcgaactgcccatcggcattcgggtgattttccagccggcagaagaagtcatgactggtggcgcaacggacgtcattgcccacggtggccttgatggtgtggatgcgatttacgccatccacgttgaacccaaattgaaggtcggtcgcgtcggtgtacgcgctggcgcgattacttctgcctcagatgtgatcgaaatcagagtcaagggtgaaggaggacatagcgcacgtccacacctctccgctgatgttgtttacgccttgagcaaattggtcgttgatcttcccggtttgctgtccaggcgcgtcgatccacgcaccggcaccgtgcttgttttcggcaccatcaacgccggctatgcgcccaacgcgatcccagattccggcatcgtgtcaggcaccttgcgtacagccgacatctctacctggcgtgacatgcgtccgcttatctctgagctggtggaacaggtgctcgcacccaccggagtcacccatgaactgatctacaatccgggtgttccaccagtgcttaacgacgatgtcgccaccgctttgttggcaagcgcagcacgcgacatggacacacaatctgttgtccaagcgccgcagtcatccggtggagaagacttctcgtggtaccttgaacacgtcccaggatcaatggcccggttgggttgctggccggggcacggacccaagcaagacctccatcaaagtgacctggttgtggatgagcgagccatcggagttggcgtcaggctctttggctcccttgtgcagcagtacagtagccgatctgaagctttcttaaattcctaatgggggtagtgtgtagggct

SEQ ID NO: 208 - protein, 395 aa, Corynebacterium glutamicum
VMEIGVQVASWMDRHHDEVIKWRRHLHSHPELSHMEYRTTEYLASVLKDHGMEPHLFPGTGLMVDIGPEGDSRLAFRADIDALPLLESTGLEFSSTATGVAHACGHDVHTVIALALACALNTIELPIGIRVIFQPAEEVMTGGATDVIAHGGLDGVDAIYAIHVEPKLKVGRVGVRAGAITSASDVIEIRVKGEGGHSARPHLSADVVYALSKLVVDLPGLLSRRVDPRTGTVLVFGTINAGYAPNAIPDSGIVSGTLRTADISTWRDMRPLISELVEQVLAPTGVTHELIYNPGVPPVLNDDVATALLASAARDMDTQSVVQAPQSSGGEDFSWYLEHVPGSMARLGCWPGHGPKQDLHQSDLVVDERAIGVGVRLFGSLVQQYSSRSEAFLNS

SEQ ID NO: 209 - DNA, 1308 bp, Corynebacterium glutamicum; identical to SEQ ID NO: 207
  CDS (101)..(1285): FRXA02855

SEQ ID NO: 210 - protein, 395 aa, Corynebacterium glutamicum; identical to SEQ ID NO: 208

SEQ ID NO: 211 - DNA, 1509 bp, Corynebacterium glutamicum
  CDS (101)..(1486): RXA00026
ccctttctggctagcctgggctacattgttggcaatttggttctacgccgatttgccgcttggacctggctctgcgatcttcctcgaaggataagttttcatgagtactgacaatttttctccacaagttccgtcgactgtgtatttggattacatggagcaagggattgccgcgcgcaaagcggaggcagaatctaacgccagcacgaagggggagagcccggattatccaggccagcaggttatttggcgcctgatccaggaagcaggggagtcgttgcgtgatgaactgcgcacactggctttcacgctgcacgaccatccggaagaagcgttcgaggaggtgttcgccaccgaggaaatcacaaaacttctgcaaaatcatggttttgaggttcagagtggagtttatggtgttaaaaccgctctagaaactagttttgaaacccctggttatgatccagcgcagcacccaagcattgcgatcttggcggaatacgatgcccttccagagatcggccatgcatgcgggcacaatatcatcgcagcagctggtgttggcgcatttttagctgtcaccaacatgatcaaaactgccgaagtgaaaggcgtggatcacctcgactttgaaggccggatcgtgctgttgggaacacctgctgaggaggggcattccggcaaggaatacatgatccgaaatggcgcattcgatggcattgatgcgtcgattatgatgcacccctttggcttcgatctggcggagcatgtttgggtgggcagacgtaccatgacggcgacgttccacggtgtctctgcacacgcgtcttcgcagcctttcatgggtaaaaatgccctcgacgctgcaagtttggcgtaccagggcttcggagttttgcgtcagcaaatgccaccgagcgaccgccttcacgccattattacggaaggcggaaaccggccaagcatcattccagacactgcaacgatgtcgctgtacgtgcgttctttgttgccggaagcactcaaagacatatcgaaacgcgtggatgatgtgctcgatggggcggccttgatggcgggggttggcgtcgaaaagcaatgggatgtgcacccagctagcttgcccgtgcgcaacaatcatgtgttggcgcggcgttgggcaaaaacgcagaatctgcgtggtcgaacggcgctttcggagggtattttgcccgacactctggcagcatcgactgattttggcaatgtctcgcacctggttccgggcattcatccgatggtgaaaatttctccggaaaacgttgcgctccacaccaaggaattcgccgcttatgcgcgcacggaagaggccatcgacgcagccgtcgacgccgcaatcgggctggcgcaagtcgccgttgacgcgcttgcagatccgcaaatgcttatcgacgcgaccctcgagttcaccaactccggcgacgtacttaaagtaggggactatttggcttaggcaacgactccgaaaccttc

SEQ ID NO: 212 - protein, 462 aa, Corynebacterium glutamicum
MSTDNFSPQVPSTVYLDYMEQGIAARKAEAESNASTKGESPDYPGQQVIWRLIQEAGESLRDELRTLAFTLHDHPEEAFEEVFATEEITKLLQNHGFEVQSGVYGVKTALETSFETPGYDPAQHPSIAILAEYDALPEIGHACGHNIIAAAGVGAFLAVTNMIKTAEVKGVDHLDFEGRIVLLGTPAEEGHSGKEYMIRNGAFDGIDASIMMHPFGFDLAEHVWVGRRTMTATFHGVSAHASSQPFMGKNALDAASLAYQGFGVLRQQMPPSDRLHAIITEGGNRPSIIPDTATMSLYVRSLLPEALKDISKRVDDVLDGAALMAGVGVEKQWDVHPASLPVRNNHVLARRWAKTQNLRGRTALSEGILPDTLAASTDFGNVSHLVPGIHPMVKISPENVALHTKEFAAYARTEEAIDAAVDAAIGLAQVAVDALADPQMLIDATLEFTNSGDVLKVGDYLA

SEQ ID NO: 213 - DNA, 954 bp, Corynebacterium glutamicum
  CDS (101)..(931): RXA01971
aggtcttgtttatttcggctactgattcagtagctgcgctccgataggattcttagttttcagttcagtatctttgagccacggctagaatgtgaatcctatgtctaagaagaagcctcgccccattccggttcctgcccaatttatccctggtctcattgatgcgcatacacatttggcatcgtgtggaggagatcttgcagggttggtggaaagggccaaggaggcgggcgtcgaaaagctttgtaccgtcggtgatggtttggctgaggccgagcttgcgctggaggccgcgcaacagtttggcaatgtgtttgctgcgtgtgcgattcatccgacgaaggctgatcagttggatggggctgcgcgtgcgcggctgacgcagatggcggcggatccgaattgtgtggccattggtgagactggtttggattcgtattggatcaagcacgatccagaggacacggcggcgttggatgtgcaagaggaggcgctgcgctggcatattgatttggcaattagtgcggataagccgttgatgattcacaatcgtgaggcggatgctgatttgatgcgagtgttggcggatgctccacctccaaaagatacgattctgcattgtttttcttcgccgttggacgtggcgaaggaagcgttggatcgtggatatgtgttgagttttgcgggcaatgtgacgtttaagcgtaatgaggagttgcgggaggctgctcgtattgcgccgatttcccagattttgattgaaaccgatgcgccgtatatgacgccggagccgtttcgggggagtaggaatgagccgtcgttgattggtcatacggcgctatgcattgcggaggttcgggggatggctgtggaggatgttgcggcggctttgaatgagaattttgatcgcgtttatggggtcacaaatctataacgtgaggtagctcacagtca

SEQ ID NO: 214 - protein, 277 aa, Corynebacterium glutamicum
MSKKKPRPIPVPAQFIPGLIDAHTHLASCGGDLAGLVERAKEAGVEKLCTVGDGLAEAELALEAAQQFGNVFAACAIHPTKADQLDGAARARLTQMAADPNCVAIGETGLDSYWIKHDPEDTAALDVQEEALRWHIDLAISADKPLMIHNREADADLMRVLADAPPPKDTILHCFSSPLDVAKEALDRGYVLSFAGNVTFKRNEELREAARIAPISQILIETDAPYMTPEPFRGSRNEPSLIGHTALCIAEVRGMAVEDVAAALNENFDRVYGVTNL

SEQ ID NO: 215 - DNA, 954 bp, Corynebacterium glutamicum
  CDS (101)..(931): RXA01802
ggaattctggacaaaagtgttcactacgttagacatgagaaccagtgtggcacatcacaggaaatcttcgcgggtgtttagacaacccggatgtgacagaatgggcgatcaagacataatcggaaaggaatccaaacaaatggactttcgcctcgtcgcgacagacatggacggcacacttttaaacacccaccacgaagtcccagagaaattttgggacatcctggaacaaatgcgtgccaaaggaatcgccttcgcaccagccagcggccgtcaattagccaccttgcaaaaacaattcgggcacgcgggtgaacccatttcttacatcgcagaaaacggcaccgtggtagtccacgacggcgaaattatctccctgaccaccatcgactccgacaccgtacactccatcatcgatgccgtgcgcgcatccgacatcgatatgggagtagtggtctgccgaccagaacgcgcctacgtcgaacgcaacgacgaagctttccgcgccgaaggcctgaaatactacgtctccatcgaggaagtccaagacctccacgaagcagtcaacaatgaagtaatcaaggtagcgatctttacattccaagatgccgaaaaggactgtgcccccatcatccgcgcagcctcccccaacgccaacgttgttgtctccggccagcactgggtcgatgtcatggatccttcagccaacaagggccaagctttggctgctctccgcgatgccctcggattggaagaatcccaaactctcgtgtttggcgactacctcaacgacactgaattgatcaaggccgccggcaagtcttacgccatgtccaatgcccacccggacattttggaattggccgacgaaattgcaccatccaacattgaagagggcgttattgtggtgctggagaagttgcttaacggttaacgattgcaggcagcaggttc

SEQ ID NO: 216 - protein, 277 aa, Corynebacterium glutamicum
MGDQDIIGKESKQMDFRLVATDMDGTLLNTHHEVPEKFWDILEQMRAKGIAFAPASGRQLATLQKQFGHAGEPISYIAENGTVVVHDGEIISLTTIDSDTVHSIIDAVRASDIDMGVVVCRPERAYVERNDEAFRAEGLKYYVSIEEVQDLHEAVNNEVIKVAIFTFQDAEKDCAPIIRAASPNANVVVSGQHWVDVMDPSANKGQALAALRDALGLEESQTLVFGDYLNDTELIKAAGKSYAMSNAHPDILELADEIAPSNIEEGVIVVLEKLLNG

SEQ ID NO: 217 - DNA, 1066 bp, Corynebacterium glutamicum
  CDS (101)..(1066): RXN00866
gcatcaacgtaggagatcctcgacttccaattatggctccaaatgagcaggaacttgaggctctccgagaagacatgaaaaaagctggagttctataaatatgaatgattcccgaaatcgcggccggaaggttacccgcaaggcgggcccaccagaagctggtcaggaaaaccatctggatacccctgtctttcaggcaccagatgcttcctctaaccagagcgctgtaaaagctgagaccgccggaaacgacaatcgggatgctgcgcaaggtgctcaaggatcccaagattctcagggttcccagaacgctcaaggttcccagaaccgcgagtccggaaacaacaaccgcaaccgttccaacaacaaccgtcgcggtggtcgtggacgtcgtggatccggaaacgccaatgagggcgcgaacaacaacagcggtaaccagaaccgtcagggcggaaaccgtggcaaccgcggtggcggacgccgaaacgttgttaagtcgatgcagggtgcggatctgacccagcgcctgccagagccaccaaaggcaccggcaaacggtctgcgtatttacgcacttggtggcatttccgaaatcggtcgcaacatgaccgtgtttgagtacaacaaccgtctgctcatcgtggactgtggtgtgctcttcccatcttcaggtgagccaggcgttgacctgattcttcctgacttcggcccaattgaggatcacctgcaccgcgtcgatgcattggtggttactcacggacacgaagaccacattggtgctattccctggctgctgaagctgcgcaacgatatcccaatcttggcatcccgtttcaccttggctctgattgcagctaagtgtaaggaacaccgtcagcgtccgaagctgatcgaggtcaacgagcagtccaatgaggaccgcggaccgttcaacattcgcttctgggctgttaaccactccatcccagactgccttggtcttgctatcaagactcctgctggtttggtcatccacaccggtgacatcaagctggatcagactcctcctgatggacgcccaact

SEQ ID NO: 218 - protein, 322 aa, Corynebacterium glutamicum
MNDSRNRGRKVTRKAGPPEAGQENHLDTPVFQAPDASSNQSAVKAETAGNDNRDAAQGAQGSQDSQGSQNAQGSQNRESGNNNRNRSNNNRRGGRGRRGSGNANEGANNNSGNQNRQGGNRGNRGGGRRNVVKSMQGADLTQRLPEPPKAPANGLRIYALGGISEIGRNMTVFEYNNRLLIVDCGVLFPSSGEPGVDLILPDFGPIEDHLHRVDALVVTHGHEDHIGAIPWLLKLRNDIPILASRFTLALIAAKCKEHRQRPKLIEVNEQSNEDRGPFNIRFWAVNHSIPDCLGLAIKTPAGLVIHTGDIKLDQTPPDGRPT

SEQ ID NO: 219 - DNA, 1045 bp, Corynebacterium glutamicum
  CDS (101)..(1045): FRXA00866
gcatcaacgtaggagatcctcgacttccaattatggctccaaatgagcaggaacttgaggctctccgagaagacatgaaaaaagctggagttctataaatatgaatgattcccgaaatcgcggccggaaggttacccgcaaggcgggcccaccagaagctggtcaggaaaaccatctggatacccctgtctttcaggcaccagatgcttcctctaaccagagcgctgtaaaagctgagaccgccggaaacgacaatcgggatgctgcgcaaggtgctcaaggatcccaagattctcagggttcccagaacgctcaaggttcccagaaccgcgagtccggaaacaacaaccgcaaccgttccaacaacaaccgtcgcggtggtcgtggacgtcgtggatccggaaacgccaatgagggcgcgaacaacaacagcggtaaccagaaccgtcagggcggaaaccgtggcaaccgcggtggcggacgccgaaacgttgttaagtcgatgcagggtgcggatctgacccagcgcctgccagagccaccaaaggcaccggcaaacggtctgcgtatttacgcacttggtggcatttccgaaatcggtcgcaacatgaccgtgtttgagtacaacaaccgtctgctcatcgtggactgtggtgtgctcttcccatcttcaggtgagccaggcgttgacctgattcttcctgacttcggcccaattgaggatcacctgcaccgcgtcgatgcattggtggttactcacggacacgaagaccacattggtgctattccctggctgctgaagctgcgcaacgatatcccaatcttggcatcccgtttcaccttggctctgattgcagctaagtgtaaggaacaccgtcagcgtccgaagctgatcgaggtcaacgagcagtccaatgaggaccgcggaccgttcaacattcgcttctgggctgttaaccactccatcccagactgccttggtcttgctatcaagactcctgctggtttggtcatccacaccggtgacatcaagctggatcagact

SEQ ID NO: 220 - protein, 315 aa, Corynebacterium glutamicum
MNDSRNRGRKVTRKAGPPEAGQENHLDTPVFQAPDASSNQSAVKAETAGNDNRDAAQGAQGSQDSQGSQNAQGSQNRESGNNNRNRSNNNRRGGRGRRGSGNANEGANNNSGNQNRQGGNRGNRGGGRRNVVKSMQGADLTQRLPEPPKAPANGLRIYALGGISEIGRNMTVFEYNNRLLIVDCGVLFPSSGEPGVDLILPDFGPIEDHLHRVDALVVTHGHEDHIGAIPWLLKLRNDIPILASRFTLALIAAKCKEHRQRPKLIEVNEQSNEDRGPFNIRFWAVNHSIPDCLGLAIKTPAGLVIHTGDIKLDQT

SEQ ID NO: 221 - DNA, 789 bp, Corynebacterium glutamicum
  CDS (101)..(766): RXA02410
tatgagactgaccatccttggaagctctggtagcgtgcccgctccaggtaaccccgcatccggatatctgttaacttctccggacgcccctgccgtgattatggacatgggcccaggtgtccttgcagcagttcaagaaattcaagatcctgctgatgcgcatgttattttctcccatttgcacaccgatcactgcgctgattttgcgtccttgatggtgtggcgcaggttccacccaacgctggccgccaagagccgcaatcttttgtttggacctgaagatacccccaacaggcttggtcgtttgagctccgatgagcctgatggcgttgacgatatgtcagatacttttgctttcgacgcctgggaagagcgcaagccagagctcattgataatttcacggtcacgccgttccgcgttgtgcaccccattgagacctacgcgcttcgcgtagaggagcaccgcaccggcgcctcaattacgtattccggtgacagcgcgtacaccgaagcgcttatcgacgccgcccgcaacgttgacattttcttgtgcgaggcaacttggggcacctcttgcgatgacaaagcaccaggaatgcatatgtgtggccaagacgccggaagaattgcggcagcagctggcgtaaagaaactgattatcactcatgttccaccatggattgatgcagaggccacagtggcagcagctgcggaacactttgatggtcctatcgaattggcacgatcaggaatggttatcgagttttagtccgtttgtactaataaggt

SEQ ID NO: 222 - protein, 222 aa, Corynebacterium glutamicum
MDMGPGVLAAVQEIQDPADAHVIFSHLHTDHCADFASLMVWRRFHPTLAAKSRNLLFGPEDTPNRLGRLSSDEPDGVDDMSDTFAFDAWEERKPELIDNFTVTPFRVVHPIETYALRVEEHRTGASITYSGDSAYTEALIDAARNVDIFLCEATWGTSCDDKAPGMHMCGQDAGRIAAAAGVKKLIITHVPPWIDAEATVAAAAEHFDGPIELARSGMVIEF

SEQ ID NO: 223 - DNA, 455 bp, Corynebacterium glutamicum
  CDS (1)..(432): RXA00961
ctagagaactggcgtatcggccgcatgttgctgcttggcgacgccgcccacgcacccctccagtacctcgcctcaggcgcggtcatggccatggaagacgccgaggctgtcgccctcttcgctgccgacgctgcgcgtgctggcaacctcgattgggaagaggtactcgcagaggtggaagctgaacgccgaccacgctgcagccgcatccaaaccgtaggccgtttctggggagagctctggcatgtggaaggcaccgcacgtctcatccgcaacgaagttttccgccaagcagaccgcaatggctggttcatctatgcagactggctgtggggttacgatgcatccaagcgtgcccacatcgccaaccctgagctcggagaaatgccacaagcactgaaggaatggcgctacgccctcctcgaacagaaatagcagcctcacctgttaaggga

SEQ ID NO: 224 - protein, 144 aa, Corynebacterium glutamicum
LENWRIGRMLLLGDAAHAPLQYLASGAVMAMEDAEAVALFAADAARAGNLDWEEVLAEVEAERRPRCSRIQTVGRFWGELWHVEGTARLIRNEVFRQADRNGWFIYADWLWGYDASKRAHIANPELGEMPQALKEWRYALLEQK

SEQ ID NO: 225 - DNA, 1116 bp, Corynebacterium glutamicum
  CDS (101)..(1093): RXA00111
ccgagaagctggagaaggccaacaagcgtggcctctacacctccgcgtccttccacagccccggcgccatcactggcgaccactaaaaaaggagacttcgatggccttttttagcttttcgacgtctcccctcacccgcctcatccccggcagccgctccaaagccacaggcgccaaacggcgcctgagcagcacaatcgcgtcgattgaacgctcccccggcatcattgccctagacggaccgttcacccacgatcacgtctccgtacgtggcattcgcctccatttagcagaggcaggctcccccaccaaacccctggttcttctgatccacggggctttcggcggttggtacgactaccgcgaagtcatcggcccactcgcagatgccggcttccacgtcgccgccatcgatctacgcggctacggcatgtccgacaaacccccaacaggctacgacctccgccacgcagccggagaactcagcagcgttatcgcagctctcggccacgatgacgcacttcttgtcggctccgacaccggcgccagcatcgcctgggctatcgcttccatgtaccccgaacgggtccgcggcctaatttccctcggcgcgatccacccccttgacatgcgacgcgccatccgacgaaaaccccacctacacgtctctgacctcagccgacttgctccttttcggttgccctcattcctgcataacctcttccacttcggaatcaccagcgaagctcgacgtgagatcgtcaacaacacgtcctcgtcctaccagcgcagcaacgcattcacagagacagtgctcctccgcaaaaaagcactatcgatcgaccacaccatcaccccgatcatccgcaccaaccgctacctcgttgggtcgatccccagcaaaacagtctccgcaccggtgtggctgctcagaaccaacactcgacgctgggaacatctagccaatactgcgcgcactcgaacgacagggccattcaccaccatcgcgatccccggcggctacgaactcccctacctcgagaacccttccgaatttgcagcaaccatcgcagagttcgcgcgcaccacgttttaagcactgtggctgaggcgctg

SEQ ID NO: 226 - protein, 331 aa, Corynebacterium glutamicum
MAFFSFSTSPLTRLIPGSRSKATGAKRRLSSTIASIERSPGIIALDGPFTHDHVSVRGIRLHLAEAGSPTKPLVLLIHGAFGGWYDYREVIGPLADAGFHVAAIDLRGYGMSDKPPTGYDLRHAAGELSSVIAALGHDDALLVGSDTGASIAWAIASMYPERVRGLISLGAIHPLDMRRAIRRKPHLHVSDLSRLAPFRLPSFLHNLFHFGITSEARREIVNNTSSSYQRSNAFTETVLLRKKALSIDHTITPIIRTNRYLVGSIPSKTVSAPVWLLRTNTRRWEHLANTARTRTTGPFTTIAIPGGYELPYLENPSEFAATIAEFARTTF

SEQ ID NO: 227 - DNA, 1020 bp, Corynebacterium glutamicum
  CDS (101)..(997): RXA01932
tttctaacctgcatccaagcctaggtggaattgagatgacgcgtcgtagagatcgaaaactcaaccaaatttcttgcctaaggcttctaggattgtcgttatgctccttcacccagatgcgcagttttatatcgataccttgcccactctcagcgcggaggagcaggtgagttttggtaaagacgctcctgtttcagaggctgatgcaacccatgtggcgacagatcaagatattgctggggtgccggtgagggtttatacgcctttatctggggctggggatttgccgtgtttggtgtacttccacggcggtggctggtccggcggcaccctcaacatgatcgatgccacggttcactctctagtggttggcctgccgatcatcgccatcagcgtggactaccgacttgcacccgcacacccatttccagcggctatcgacgacgcgtttgcagtggtcagtgccgtattggatggggtgtctgggctgagtattgatacttcccgagtggcaattggcggtgacagtgccggtggaaatattgccgcggttactgcacaacagctgcgtgaacgggctgtgggttctactcctgtattggctcaccaggtgcttatttttccggtaactgatgtttccactacatctacgccgagctatctcacatttggcaaagattgctacctgacaaaggacgcgatggaacgctacatcgaacaatatgccgatgggcacgaccgcaccgaccctcgactctcaccgctactggcatctgatttgagcgacctcccacccaccaccattgtgtacggcgaatgcgacgtgttagcccatgaagtgcgagcctatggacaagctctactagaggctggaaattccgtgacgatgactgaattcaaaggacagatccacgcctttattaacctagggggaatcagttccgatgcgcgggctgctcgacgactcatccgcgccgaattggaagcagcactttgttaaaggttgagatttaacattcg

SEQ ID NO: 228 - protein, 299 aa, Corynebacterium glutamicum
MLLHPDAQFYIDTLPTLSAEEQVSFGKDAPVSEADATHVATDQDIAGVPVRVYTPLSGAGDLPCLVYFHGGGWSGGTLNMIDATVHSLVVGLPIIAISVDYRLAPAHPFPAAIDDAFAVVSAVLDGVSGLSIDTSRVAIGGDSAGGNIAAVTAQQLRERAVGSTPVLAHQVLIFPVTDVSTTSTPSYLTFGKDCYLTKDAMERYIEQYADGHDRTDPRLSPLLASDLSDLPPTTIVYGECDVLAHEVRAYGQALLEAGNSVTMTEFKGQIHAFINLGGISSDARAARRLIRAELEAALC

SEQ ID NO: 229 - DNA, 1131 bp, Corynebacterium glutamicum
  CDS (101)..(1108): RXA02574
tgtgctccttgcgggctgcgcagaagagccggaacagcaaaaagcaataagccgcttatcgacgtccccctccacccctcccgcaccgaccgcggaggatttggcgcgcgcgcaaatccctgaacagcaacgcgaccaagtcgcgtcgctgatgatggttggagttgcgaattatgatcaggcattggatgcgctcaatcagggggtgggtggcatctttattggttcctggacagatgaaaatctgctcacggaacctggccgtaatattgaggcgctccgcgaagccgtcggcagggatttctccgtcagcatcgacttcgaaggcggccgcgtccagcgtgccaccaatattcttggtgatttcccctcaccgcgcgtgatggcgcaaaccatgacgccggaacaagtagaagatctcgcagaaatcctaggcactggtttagctgcacatggtgtgacagttaactttgcacctgttgtagatgtagatgcttggggtctccccgtcgttggcgatcgttccttttccaacgacccagccgtagcagctacttatgccacagcttttgcaaagggcttaagcaaagtaggaattaccccagtattcaaacatttcccaggtcacggtcgtgcaagtggcgattcgcacacccaagatgtggtgacccccgcacttgatgagcttaaaacttacgacctcatcccttatggtcaagcactttctgaaactgacggagccgtcatggtgggccacatgattgttccaggtcttggcaccgacggagttccatcctctatcgaccccgccacctatcaactgctccgcagtggcgattacccaggtggcgtgcctttcgatggcgtgatctacaccgacgatctctctggaatgagtgccatttccgccacccattcacccgcagaagcagtgcttgcctccctcaaagcaggcgcagaccaagcactatggatcgactatgggtcgttgggctccgcgattgatcgcgttgatgctgccgttagcagcggtgaataccctcaagaacaaatgctggcatctgcgttaagagtccaattgctctacatcacacgtctcgaacaaaagtgaagttaccagtccgtaacccc

SEQ ID NO: 230 - protein, 336 aa, Corynebacterium glutamicum
LARAQIPEQQRDQVASLMMVGVANYDQALDALNQGVGGIFIGSWTDENLLTEPGRNIEALREAVGRDFSVSIDFEGGRVQRATNILGDFPSPRVMAQTMTPEQVEDLAEILGTGLAAHGVTVNFAPVVDVDAWGLPVVGDRSFSNDPAVAATYATAFAKGLSKVGITPVFKHFPGHGRASGDSHTQDVVTPALDELKTYDLIPYGQALSETDGAVMVGHMIVPGLGTDGVPSSIDPATYQLLRSGDYPGGVPFDGVIYTDDLSGMSAISATHSPAEAVLASLKAGADQALWIDYGSLGSAIDRVDAAVSSGEYPQEQMLASALRVQLLYITRLEQK

SEQ ID NO: 231 - DNA, 1599 bp, Corynebacterium glutamicum
  CDS (101)..(1576): RXN00983
gtgagaaaacagtggctcaaatatcgacatcttctactcacagttcaacctgtcgtggctggaggccggctgcattggtgtcgacgccgatgaaacgtccgtgactgcaggtgaaaccaccactatgaatgtcacgttgaccaatcctttcgacaacgcaatttttgaccgagcagtctcccttgaacgtcccgaaggatggcaagctgaggatgttcgtgtgtcgatcccatctggagaatctgtcacaatcccagtccaggtcacagcaccgctggtagccgacaacggtgaacttccagtggaggtgtccattcttgatggagcagaccgctacacgggtcgtctcaatctcactgttcagggtgggcaagaacctgcaccaacttcagtgaaggtgagcattccaaatctcaaggacacttatgtagcaggggagaagatcagcattaactttgcggtcaacaacccgtttgacgttacggttaattcggtgccaagcctgggggaaggcgagaactggatgcctgcaaacctacgcggatttgatccagagcagggtactcccaactgtcgttacaagaatttaggcgcgaataagagctatgactgcaccacaactacctatgaagtcagcgatttggatgtagaacgcggatacgtggatattccaacggtatggacgtttactaactccgcaggcgaaacggtatggtccaaaaacgttgatgtgcctcgagttgaactcaatggaacacaggatgctgtcactgatgcaatcgtaacggttgatcccatcaacccagttcattccaacggccagagccaaactgttgaggtccaggctaatgtcacctcagagggagatctgccagctggatctaaggtggccttttatctagattcatcgcccattgataccgcagctgttgatgcggaagggcatgccagcatctcgattgatgtggacaacatcgcaagcgagcagcctgaacgcacatttgaggttcgcgcccgactcgtcgttccagaagatgcaccacgatcaatcgcgcgtgatgccttggcacgttttacagtcctgtctgaacaagtgcagcagaactccttggtgatcatgaatcatccagatgtgttttctgatggacaaacaaagactattgtcatcgcagcgaaggcgacagcacacgatggatcgccggtggctatcggtactctcattgcatttcgcgtcaacggtattgagcgggacgtggttccaactaacgcgcaaggaacagcaaagcttcagctagacctcaagccagtaaatactgaagacgaggaatatgaagtaacagttgaagccgagctggatgaattgactgctcagaccacgttcaaagtacttgctggtgaggaagaggaacccaccagcaccgaagaacaaccgtcagaaactgagcagccttctgaacctgaagaggaatcgactggtgttgctggaagctctaacggtggcagttttgtcgcgcttttagcgctgctggcagcgcttggtggcatcgtcggtgcagtcctcggattgcttaagttgtaggtggctgggggcgtcgaaaa

SEQ ID NO: 232 - protein, 492 aa, Corynebacterium glutamicum
VTAGETTTMNVTLTNPFDNAIFDRAVSLERPEGWQAEDVRVSIPSGESVTIPVQVTAPLVADNGELPVEVSILDGADRYTGRLNLTVQGGQEPAPTSVKVSIPNLKDTYVAGEKISINFAVNNPFDVTVNSVPSLGEGENWMPANLRGFDPEQGTPNCRYKNLGANKSYDCTTTTYEVSDLDVERGYVDIPTVWTFTNSAGETVWSKNVDVPRVELNGTQDAVTDAIVTVDPINPVHSNGQSQTVEVQANVTSEGDLPAGSKVAFYLDSSPIDTAAVDAEGHASISIDVDNIASEQPERTFEVRARLVVPEDAPRSIARDALARFTVLSEQVQQNSLVIMNHPDVFSDGQTKTIVIAAKATAHDGSPVAIGTLIAFRVNGIERDVVPTNAQGTAKLQLDLKPVNTEDEEYEVTVEAELDELTAQTTFKVLAGEEEEPTSTEEQPSETEQPSEPEEESTGVAGSSNGGSFVALLALLAALGGIVGAVLGLLKL

SEQ ID NO: 233 - DNA, 1297 bp, Corynebacterium glutamicum
  CDS (101)..(1297): FRXA00983
gtgagaaaacagtggctcaaatatcgacatcttctactcacagttcaacctgtcgtggctggaggccggctgcattggtgtcgacgccgatgaaacgtccgtgactgcaggtgaaaccaccactatgaatgtcacgttgaccaatcctttcgacaacgcaatttttgaccgagcagtctcccttgaacgtcccgaaggatggcaagctgaggatgttcgtgtgtcgatcccatctggagaatctgtcacaatcccagtccaggtcacagcaccgctggtagccgacaacggtgaacttccagtggaggtgtccattcttgatggagcagaccgctacacgggtcgtctcaatctcactgttcagggtgggcaagaacctgcaccaacttcagtgaaggtgagcattccaaatctcaaggacacttatgtagcaggggagaagatcagcattaactttgcggtcaacaacccgtttgacgttacggttaattcggtgccaagcctgggggaaggcgagaactggatgcctgcaaacctacgcggatttgatccagagcagggtactcccaactgtcgttacaagaatttaggcgcgaataagagctatgactgcaccacaactacctatgaagtcagcgatttggatgtagaacgcggatacgtggatattccaacggtatggacgtttactaactccgcaggcgaaacggtatggtccaaaaacgttgatgtgcctcgagttgaactcaatggaacacaggatgctgtcactgatgcaatcgtaacggttgatcccatcaacccagttcattccaacggccagagccaaactgttgaggtccaggctaatgtcacctcagagggagatctgccagctggatctaaggtggccttttatctagattcatcgcccattgataccgcagctgttgatgcggaagggcatgccagcatctcgattgatgtggacaacatcgcaagcgagcagcctgaacgcacatttgaggttcgcgcccgactcgtcgttccagaagatgcaccacgatcaatcgcgcgtgatgccttggcacgttttacagtcctgtctgaacaagtgcagcagaactccttggtgatcatgaatcatccagatgtgttttctgatggacaaacaaagactattgtcatcgcagcgaaggcgacagcacacgatggatcgccggcggctatcggtactctcattgcatttcgcgtcaacggtattgagcgggacgtggttccaactaacgcgcaaggaacagcaaagcttcagctagac

SEQ ID NO: 234 - protein, 399 aa, Corynebacterium glutamicum
VTAGETTTMNVTLTNPFDNAIFDRAVSLERPEGWQAEDVRVSIPSGESVTIPVQVTAPLVADNGELPVEVSILDGADRYTGRLNLTVQGGQEPAPTSVKVSIPNLKDTYVAGEKISINFAVNNPFDVTVNSVPSLGEGENWMPANLRGFDPEQGTPNCRYKNLGANKSYDCTTTTYEVSDLDVERGYVDIPTVWTFTNSAGETVWSKNVDVPRVELNGTQDAVTDAIVTVDPINPVHSNGQSQTVEVQANVTSEGDLPAGSKVAFYLDSSPIDTAAVDAEGHASISIDVDNIASEQPERTFEVRARLVVPEDAPRSIARDALARFTVLSEQVQQNSLVIMNHPDVFSDGQTKTIVIAAKATAHDGSPAAIGTLIAFRVNGIERDVVPTNAQGTAKLQLD

SEQ ID NO: 235 - DNA, 440 bp, Corynebacterium glutamicum
  CDS (1)..(417): RXA00984
caacgtggtaccccagtgctccttggggaaactccatggatgaaaacaaaaatcgtggaactcagcgatggaaccctgatgaacaacagtcgttcatcaggagccgatacttaccgcaaggtgtcttattccaccgacggcggcgtcacttggaccgagccaactcttgatacccagctgccggatcctcgcaacaatgcttccctgattcgagtattcccgacagcacctgagggaagtgcgcaggcaaaggttctgctgttctccaacactgccaccacgagtggccgcaccaatggcaccgtccgcatgtcgtgtgatgatggtcagacctggccggtgtctaaggtgtttgaaccaggagcaatccaatatacctcgatggcaacgcttcccaacggtgacatcggcatgctgtgagaaaacagtggctcaaatat

SEQ ID NO: 236 - protein, 139 aa, Corynebacterium glutamicum
QRGTPVLLGETPWMKTKIVELSDGTLMNNSRSSGADTYRKVSYSTDGGVTWTEPTLDTQLPDPRNNASLIRVFPTAPEGSAQAKVLLFSNTATTSGRTNGTVRMSCDDGQTWPVSKVFEPGAIQYTSMATLPNGDIGML

SEQ ID NO: 237 - DNA, 832 bp, Corynebacterium glutamicum
  CDS (101)..(832): RXN02513
acagcaccgttttgtaggataagaaaatcccgcacacaacccgtcctggtgggtgaagtgggggaggcatgtctatgcccccaattagacatctgacatcatgcttccaatctggatgggtcttccattcaagaaagcaggtgctttgtctcggcgtaaagcagtattctcagcgcttggtgcagccgcactcatgggcgcagcactacccaccatcccaacggcccaagctcaaacacccacgggctacggattcgatgcaacagcaagcatcagcgaagaaccagagttttcaacacaacaactcgctgacggcggaactctcggatttgattgctaccgcatcccatcgcttggcgtcgcacccaacggcaacgtcctcgcatcgtgggatggtcgcccaaacaactgttcagatgctccacaacccaactccatcgtgggcaaggtatcgaccgacaacggagcaacctggggcgaacagcacgacatttccgcaggtatcaccgccgaacccaaaactggctattccgatcccagcatcgttgtggactgggagaggggcgatgtctttaacttccacgtgaagtcattcgatgcaggatacttcacctcccaaccaggcacggacccggatgatcgcaacgttgcccatgttgcctacgccaaatcatcagataacggctcaacctgggttgcagacaccgtcattactgatcaagtggttgctcatgacacctgggacagccgatttgccacatccggaaacggcatccaactgcaatacggcgcgtacaagggacgattggtccagccatcggtaactcgcatg

SEQ ID NO: 238 - protein, 244 aa, Corynebacterium glutamicum
MLPIWMGLPFKKAGALSRRKAVFSALGAAALMGAALPTIPTAQAQTPTGYGFDATASISEEPEFSTQQLADGGTLGFDCYRIPSLGVAPNGNVLASWDGRPNNCSDAPQPNSIVGKVSTDNGATWGEQHDISAGITAEPKTGYSDPSIVVDWERGDVFNFHVKSFDAGYFTSQPGTDPDDRNVAHVAYAKSSDNGSTWVADTVITDQVVAHDTWDSRFATSGNGIQLQYGAYKGRLVQPSVTRM

SEQ ID NO: 239 - DNA, 824 bp, Corynebacterium glutamicum
  CDS (93)..(824): FRXA02513
gtcatgtaggataagaaaatcccgcacacaacccgtcctggtggggtaagtgagggaggcatgtctatgcccccaattagacatctgacatcatgcttccaatctggatgggtcttccattcaagaaagcaggggctttgtctcggcgtaaagcagtattctcagcgcttggtgcagacgcactcatgggcgcagcactacccaccatcccaacggcccaagctcaaacacccacgggctacggattcgatgcaacagcaagcatcagcgaagaaccagagttttcaacacaacaactcgctgacggcggaactctcggatttgattgctaccgcatcccatcgcttggcgtcgcacccaacggcaacgtcctcgcatcgtgggatggtcgcccaaacaactgttcagatgctccacaacccaactccatcgtgggcaaggtatcgaccgacaacggagcaacctggggcgaacagcacgacatttccgcaggtatcaccgccgaacccaaaactggctattccgatcccagcatcgttgtggactgggagaggggcgatgtctttaacttccacgtgaagtcattcgatgcaggatacttcacctcccaaccaggcacggacccggatgatcgcaacgttgcccatgttgcctacgccaaatcatcagataacggctcaacctgggttgcagacaccgtcattactgatcaagtggttgctcatgacacctgggacagccgatttgccacatccggaaacggcatccaactgcaatacggcgcgtacaagggacgattggtccagccatcggtaactcgcatg

SEQ ID NO: 240 - protein, 244 aa, Corynebacterium glutamicum
MLPIWMGLPFKKAGALSRRKAVFSALGADALMGAALPTIPTAQAQTPTGYGFDATASISEEPEFSTQQLADGGTLGFDCYRIPSLGVAPNGNVLASWDGRPNNCSDAPQPNSIVGKVSTDNGATWGEQHDISAGITAEPKTGYSDPSIVVDWERGDVFNFHVKSFDAGYFTSQPGTDPDDRNVAHVAYAKSSDNGSTWVADTVITDQVVAHDTWDSRFATSGNGIQLQYGAYKGRLVQPSVTRM

SEQ ID NO: 241 - DNA, 733 bp, Corynebacterium glutamicum
  CDS (101)..(733): RXA00903
gcactcggaatcgtcgtcctagaaaagaaagacgcctaaaatgccctctaaaatatcgcggccctattaccaagtagatgtattcagctccgagccgttcatgggaaacccgcttgctgtcatcgccgatgctgatgacttaagtgccgaacaaatggcccgaatcgctaggtggacaaacctctcagaaaccacatttcttttaaagccaacccaagaaggtgctgactaccgggtacgcattttcaccccaaccggtgagctccccttcgctggacacccaacactcggaaccgcccacgtgtttagggaactgcacggtgaacagggaacccagttggttcaggaatgtgtcgccggtttagttgctgtgcgcgctattgacgggccagcaagtggattggcttttcaggctccacccacactcaaagacgggccattggatgcttccgacctagacgcagcttgtgaggctttaggaatcagccccgacttcattcgagcccaccaatgggtagacaacggccccggctgggcagtagtggagctaccgagcgcccaacacgtattggatctggaacccgatttcagtgcacatccaacattgaaactcggagtgattggggcctatcccgaaggggctccccacgcctttgaagtacgggcattcgctcaaggaatcggtgaagacccagttacaggaagcctcaatgcattcattgcgcagtggcta

SEQ ID NO: 242 - protein, 211 aa, Corynebacterium glutamicum
MGNPLAVIADADDLSAEQMARIARWTNLSETTFLLKPTQEGADYRVRIFTPTGELPFAGHPTLGTAHVFRELHGEQGTQLVQECVAGLVAVRAIDGPASGLAFQAPPTLKDGPLDASDLDAACEALGISPDFIRAHQWVDNGPGWAVVELPSAQHVLDLEPDFSAHPTLKLGVIGAYPEGAPHAFEVRAFAQGIGEDPVTGSLNAFIAQWL

SEQ ID NO: 243 - DNA, 1146 bp, Corynebacterium glutamicum; identical to SEQ ID NO: 175
  CDS (101)..(1123): RXA01224

SEQ ID NO: 244 - protein, 341 aa, Corynebacterium glutamicum; identical to SEQ ID NO: 176

SEQ ID NO: 245 - DNA, 723 bp, Corynebacterium glutamicum
  CDS (101)..(700): RXA01571
aaactacctgctgagagctttgtaatttacggtgtggttgtggaggggtgcgtcgagaagcgctcgtaggcgcttttgatttttcggtaggctaactggggtgagtatctcagtaaaagcactacaaaagtccggcccagaagcacctttcgaggtcaagatcattgaacgccgtgacccacgcgcagatgatgtggttattgatatcaaagctgcgggcatctgccacagcgatatccacaccatccgcaacgaatggggcgaggcgcacttcccgctcaccgtcggccacgaaatcgcaggcgttgtctctgcggttggatccgatgtaaccaaatggaaagtcggcgaccgcgtgggcgtcggctgcctcgttaactcctgcggcgaatgcgaacagtgcgtcgcaggatttgaaaacaactgccttcgcggaaacgtcggaacctacaactctaacgacgtcgacggcaccatcacccaaggcggctacgctgaaaaggtagtggtcaacgaacgtttcctgtgcagcatcccagaggaacttaacttcgatgtcgcagcaccactgctgtgcgcaggcatcaccacctactccccaatcgctcgctggaacgttaaagaaggcgacaaagtagcagtcatgggcctcggcgggactcggacacatgggtgtccagatcgctgcagccaagggtgctgaggttaccgttctgtcccgtt

SEQ ID NO: 246 - protein, 200 aa, Corynebacterium glutamicum
VSISVKALQKSGPEAPFEVKIIERRDPRADDVVIDIKAAGICHSDIHTIRNEWGEAHFPLTVGHEIAGVVSAVGSDVTKWKVGDRVGVGCLVNSCGECEQCVAGFENNCLRGNVGTYNSNDVDGTITQGGYAEKVVVNERFLCSIPEELNFDVAAPLLCAGITTYSPIARWNVKEGDKVAVMGLGGTRTHGCPDRCSQGC

SEQ ID NO: 247 - DNA, 1338 bp, Corynebacterium glutamicum
  CDS (101)..(1315): RXN02478
gacatcgtcgaagcgctctccagcggcaacatcgacgattatcgcagcgccgtgctcgctcactacgcgccgtttcgccgcatgatttccaacatgctcgatgcgcactagcctcattgcgcgcgggttgtaccgcattcccgcgctggtctgggatcagggtcttttaacgcttttcgacgcccgcctcagtgttgacgacctccccgcacccatcgacgtggtgtcagcgcgatcctcagacggcatcacctggaccaccccagaaccagcaatcgtcgaaactgaacaccgcggtgtgggcgatgtctgccttgtcacgggcgatctgtgcttccacggattgtccaacctcgcaggattttttgaggatcccaccgaccttgaaccccggctggcgcgccgggatgtgagtgggtggacgtcgataagcatggcccactattttgcggatgttgatgccgcgttcgcctcgtcggggacgggacttgtcctggcggatgggcggtggattcagagttttgtggtgcggcgcgggcgcgagatttcgcttcggattctgcgcagcgatggccacatcaccgatattgccggcggtaacgaatccgcgatgacgcagctgccgagcggtcggattgtgctgcattccaggggggtgggacaccgtctgagcagtgtgtccgatgatttcggggagacattcactccgctggagcctgtgcctgaactaatcgaccccggctgcaacggccacgtgttctactggaaagcggctggaatgctcgccgcaacgcacctggcggaccctgatctgcgacgccacttggtggttgatttatccagcgacgaaggagcgacctgggcgcatcgcatcaccatcgagcgcgaagaagccgcctattcaaccgctgcggaaatgcccaacggagatgttgccgtggtgtgggaagcagagggaacgcgcgcgataaaatgcacggtgatcagcgtaaatgatatttcgctgcggatcgatgagcccatttccgatgccatatccctccgccatgtggtgatcaacgatgaccatgacggcatcgaagtcgcactgcctgacgcatcgcaatggggtgaaggtgtattcaaaattgtgtccaatccagacgcgagcacccaaaaaatccgcactcgaggcaagcccgcgcgacagaccctggaaattggggatgaattggtttttgatatccgcaagggtggagaagtggcttacggcgtcacggttccttatgatggtcgctcgttgggggaagttaaacaggattttggagtggggctgtagaggccgatttgcggtccttt

SEQ ID NO: 248 - protein, 405 aa, Corynebacterium glutamicum
MRTSLIARGLYRIPALVWDQGLLTLFDARLSVDDLPAPIDVVSARSSDGITWTTPEPAIVETEHRGVGDVCLVTGDLCFHGLSNLAGFFEDPTDLEPRLARRDVSGWTSISMAHYFADVDAAFASSGTGLVLADGRWIQSFVVRRGREISLRILRSDGHITDIAGGNESAMTQLPSGRIVLHSRGVGHRLSSVSDDFGETFTPLEPVPELIDPGCNGHVFYWKAAGMLAATHLADPDLRRHLVVDLSSDEGATWAHRITIEREEAAYSTAAEMPNGDVAVVWEAEGTRAIKCTVISVNDISLRIDEPISDAISLRHVVINDDHDGIEVALPDASQWGEGVFKIVSNPDASTQKIRTRGKPARQTLEIGDELVFDIRKGGEVAYGVTVPYDGRSLGEVKQDFGVGL

SEQ ID NO: 249 - DNA, 1213 bp, Corynebacterium glutamicum
  CDS (101)..(1213): RXN00343
ttcggtagaatgggtaggttgtcgtgcttgaggtgtggtggataaccacctctacaacaccacccaagctctgttagaaaaaattgaggaagcagtctaaatgaaacaccaatatgatgtcatcgttgtcggttccggcgctggcggattatcagctgcagtcagtgcagcttacggcggtaagaaagtcgctgtaattgaaaaggcctcagtactcggtggagccaccacctggtccggcggttgggcttggactcctggaaccagccttgcgcgcaaagacggagtagtggaatccaaagaagaattccaaacctacctgcaagcggtagtgggggagtactaccaagaagacaacatctccgccttcttggacgcagcccctgaaatggtcgatttctttgaaaaaaacaccgacctgcagtggacccccggcgcgaaaatcaacgacatctacggcaacctccccggtgctggcactggacaccgctccgttgggccaaaaccattcaacggacgcaaagtacccaagagtgttcttccaaaactgcgccaccagctgtatgaaacctccttcctgggaatgggcatcatggctgggcctgacctgacgaaattcctctctgcttcacagttcgatccacgtggttgggtacatgccgccaggcgcgtcatcgtgcacatgtgggacatggtcgtgcacaaacgcaatatgcagatggtcaacggtgcagcactcaccgctcgactggctacctctgcagacaagctgggcgttgatctcctggtcaatcactccgcagtgtcgttgaattacaaaaacgaccgcgttaccggcgtgaaagtacaaaccccacagggcttggtagatttcgaagccactgccggcgtcgtgctcgccactggtggattccccaacaacgttgacctgcgcaaggaactcttcccacgcaccccatcaggtcaagaacactggaccctcgcgccagcagaaaccaccggcgacggactatccatggctcgggaaatcggtgcaggttttgtcaacgacctgaaatccccagcagcatggtgccctgtttcattggtcccatacttcaacggaaaagtcggcaccttcccccacatcatggaccgcgcaaaaccaggctccatcggtgttgtctccacaggtaagcgattcgtcaatgaagccaacggctactacgactac

SEQ ID NO: 250 - protein, 371 aa, Corynebacterium glutamicum
MKHQYDVIVVGSGAGGLSAAVSAAYGGKKVAVIEKASVLGGATTWSGGWAWTPGTSLARKDGVVESKEEFQTYLQAVVGEYYQEDNISAFLDAAPEMVDFFEKNTDLQWTPGAKINDIYGNLPGAGTGHRSVGPKPFNGRKVPKSVLPKLRHQLYETSFLGMGIMAGPDLTKFLSASQFDPRGWVHAARRVIVHMWDMVVHKRNMQMVNGAALTARLATSADKLGVDLLVNHSAVSLNYKNDRVTGVKVQTPQGLVDFEATAGVVLATGGFPNNVDLRKELFPRTPSGQEHWTLAPAETTGDGLSMAREIGAGFVNDLKSPAAWCPVSLVPYFNGKVGTFPHIMDRAKPGSIGVVSTGKRFVNEANGYYDY

SEQ ID NO: 251 - DNA, 1083 bp, Corynebacterium glutamicum
  CDS (101)..(1060): RXN01555
ctggttttgtgccgaggatcagccagcaagttaatgatccttacatggcgctgttgttggcgcggtagtcaatcatgggggagtatcccaccgtatccgcgtgaacaagggcgtggtgctggtagcaggtggattctcccagaatccagaactgcgcatgaagtacatgccagaacccaccccacagttctcccgcaccaacgaaagcgccaccggcgacaccatggcccttgctgcgaaagtgggagcacgcctaggcgacgacaacggtgaaaacgcactgtggttcccatcgtccatcggcacccgcgccgacggatccaccgcggtgtacccacacatttgggaccgtggccgcctcggagtcatcgcagtcaacgcagcaggcgagcgtttcgtcgatgaatccgtctcctaccaccgcttcgtgcgcgccatgtacgaatccaacaaaaccaccccgactgtttcagcctggctcattgttgattcccacaccctggcaaaatacggcctcggcatgatcaccatgccacacctgcctaaactcgctctgcaaaaatacatcgactccggatacctgcacgcaggatcatccttggatgaattggcacgcagcattggtgtggacgctcgcggcctggaacaaaccgtcaaacgctacaataccttcgctaaaacgggtatcgacgaagacttccacaagggcgaactcctcttcggtcaagccgccggcgatccagacaacaagccaaaccccaacgtcggaccaatcaagaagggaccgttctacgcaatcgctgtagtcccaacccctctggccactgcctttggcatcagcatcaaccccaacggacaggttgttagtgaagatggggagcccatcattggactgtactccgcaggaaatgatgcccaatctgtcatggcttctgaatatcctggtgctggttcacaggttggttccggaatgacctttggttggatcgcagcacagcacgcggtggggaaagcgggaaaatccggaggagctaaggcaggatatgccgcgtcttctaagtaattgcttggtgggttgcttac

SEQ ID NO: 252 - protein, 320 aa, Corynebacterium glutamicum
VNKGVVLVAGGFSQNPELRMKYMPEPTPQFSRTNESATGDTMALAAKVGARLGDDNGENALWFPSSIGTRADGSTAVYPHIWDRGRLGVIAVNAAGERFVDESVSYHRFVRAMYESNKTTPTVSAWLIVDSHTLAKYGLGMITMPHLPKLALQKYIDSGYLHAGSSLDELARSIGVDARGLEQTVKRYNTFAKTGIDEDFHKGELLFGQAAGDPDNKPNPNVGPIKKGPFYAIAVVPTPLATAFGISINPNGQVVSEDGEPIIGLYSAGNDAQSVMASEYPGAGSQVGSGMTFGWIAAQHAVGKAGKSGGAKAGYAASSK

SEQ ID NO: 253 - DNA, 1428 bp, Corynebacterium glutamicum
  CDS (101)..(1405): RXN01166
accgtacccacagacacaccagaattaacagaaacagactgaaaaacaacatcgctcgacatgcgcgtaatcctaacccgcgcacactaatgtggccgatatgggctacaccaacctcaacgacacacgggtcttgcgcgccgggtcatgtgatgcctggtggcgcacgatgtctccgctagtgcagcagggaagtgaggcagtctttcggcgcatcatgggtctctcgcggcgtcctgatcggaaacctggctttgacgatgtcccacatttcggcgcagctgttcgagttcccggtctaaaacacggcacgttggtcaatgctgcacccttgaaagttttgggcgcacggggcgagcccaaccccgcgagttcgtaccgttttgaatacatcaccggtgattccgcaggtcgagccatcactgcgaccggcgctgtcctcttttccacacgcccctggacaaccggcccgcgtcccgcgatcgccatggctccatccacccaaggcgtcgcacagcactgcgatccctcccacacctgcgccatcggactcaacgcattctatgacaaacccttcgacgcaatcattgcttacgaactccccgtcatcctctggtttctagctcacggacttgacgttgtgttcatcgattacccccgcgaccccgcaaccggcgtccaatactattgcgattccatcgctgcagctaaatcgcttctcgacgccgtcctcgcctccagacaactcggcctttcaccggaagcaccgcttggcctgtggggattctcccaaggaggcggcgccactggctgggctgcacaattgcaggattacgcacctgatgtccgcccaaaggcagcggtcgtgggcgctccaccagtggatctcttccgcgtcttggacactgtcgacggcggattgctcaccggagtgattgcctacgccatcgcgggacttgcagtgaactcttcagagatgtttgaggaaatcatgtcggtgttaaatgaacgcggagtcagtgatgtgctgaaaaatatcaccagctgcgcgggaggttccttgttggccagtggctactcgtcttcccgcgggtggacacatcagggcacgccgctggcagacattctggacgatctgccacttgttgtcgctgagtttgggaagcaaaagctgggtcgtgtggcgccagaaatcccagtgctgttgtggggctctaaaaatgatgatgtcattcccattgatcccattagggaattgcgtgatagctgggcggacaagggtacgccattgacctggcatgaatcccaagcgccgcgtgtgccaggacgcacaggtctcaaccatttcgggccctattttagaaacctggaaaagtactcgggatggctcatagatcatcttgtctgagtgccgttttaaaggctcgg

SEQ ID NO: 254 - protein, 435 aa, Corynebacterium glutamicum
MGYTNLNDTRVLRAGSCDAWWRTMSPLVQQGSEAVFRRIMGLSRRPDRKPGFDDVPHFGAAVRVPGLKHGTLVNAAPLKVLGARGEPNPASSYRFEYITGDSAGRAITATGAVLFSTRPWTTGPRPAIAMAPSTQGVAQHCDPSHTCAIGLNAFYDKPFDAIIAYELPVILWFLAHGLDVVFIDYPRDPATGVQYYCDSIAAAKSLLDAVLASRQLGLSPEAPLGLWGFSQGGGATGWAAQLQDYAPDVRPKAAVVGAPPVDLFRVLDTVDGGLLTGVIAYAIAGLAVNSSEMFEEIMSVLNERGVSDVLKNITSCAGGSLLASGYSSSRGWTHQGTPLADILDDLPLVVAEFGKQKLGRVAPEIPVLLWGSKNDDVIPIDPIRELRDSWADKGTPLTWHESQAPRVPGRTGLNHFGPYFRNLEKYSGWLIDHLV

SEQ ID NO: 255 - DNA, 1281 bp, Corynebacterium glutamicum
  CDS (101)..(1258): RXN02001
gcggtttcgtcatggataaggactgtgttcgggaccattgcgatactcgtgtcaaaaggcgatagtccagcatagaccgtgctttatcgaaggtgaacccatgcccgttatcaatagtatcgccagtttttccgacgagatgacccgctggcggcgtcacctgcatcaaaaccccgaaatcagctttgattgtgtggaaactgcggccttcgtggccgagcagctgcgcagcttcggggtggatgaaattcacaccggcatcgcgaaaaccggtatcatcgccctgattcacgggcgcgaggctggccccgtcgtcggcctgcgcgccgatatggacgcgctgccgctgaccgagattaccggcgtcgactatgcctcgaccacccccggaaaaatgcacgcctgcggccacgacggccacacgaccatgctgctgggcgccgccaaatatctggccgagacgcgcaatttcgcaggtaccgtcgcgctgatcttccagcctgcggaagaaaacggcggcggcgcgggcgttatggtcgatgaaggcgtcctcgaccgctttgccatcgccgaagtctacgccctgcacaaccagcccggcctgccgcttggccattttatgacgacagccggcccgatcatggccgctgtcgacacgttcgacatcaacattaccggacgcggcggccacggtgccaaaccgcaccaaacccgcgaccccatcgtcgcagccgtcggaattgtccaagcgtttcaaacgatagtcagccggaatcacaatccggtcgaggaccttgtcgtgtcggtcacgcaaatccacaccggcagcgccgataatatcatccccgaaaccgcctatatcaacggcactgtccgcaccttcaacaaagacgtgcaggccatggtcatcacgcggatggaagaaatcgtcgcgggccaagctgcagcctatggggtcgaggcgacgctgacctacaaccgcaactatcccgccaccattaacgacgccgccaaagccgccatcgctgccgaagtcgcgggcgaggtcggcctcggggtcaacccgaacggctcgcgcgggatgggggccgaggatttctcgtatttcctcgaaaagcgcccgggtgcctacctgttcgtcggtaatggcgacagcgcgggccttcacaaccccgcctataatttcaacgacgaggccgcgccctacggcgcatcgttcttggcccgcatggcagaacgccccttgccgttaaagggctgatccatggcgctcgaagatgc

SEQ ID NO: 256 - protein, 386 aa, Corynebacterium glutamicum
MPVINSIASFSDEMTRWRRHLHQNPEISFDCVETAAFVAEQLRSFGVDEIHTGIAKTGIIALIHGREAGPVVGLRADMDALPLTEITGVDYASTTPGKMHACGHDGHTTMLLGAAKYLAETRNFAGTVALIFQPAEENGGGAGVMVDEGVLDRFAIAEVYALHNQPGLPLGHFMTTAGPIMAAVDTFDINITGRGGHGAKPHQTRDPIVAAVGIVQAFQTIVSRNHNPVEDLVVSVTQIHTGSADNIIPETAYINGTVRTFNKDVQAMVITRMEEIVAGQAAAYGVEATLTYNRNYPATINDAAKAAIAAEVAGEVGLGVNPNGSRGMGAEDFSYFLEKRPGAYLFVGNGDSAGLHNPAYNFNDEAAPYGASFLARMAERPLPLKG

SEQ ID NO: 257 - DNA, 570 bp, Corynebacterium glutamicum
  CDS (101)..(547): RXN03145
agaggtgtttaaattcccgcctctgccccagatttaaaactatgatgagggatagcttctcaattttccaggttttccaaaatgaaagaggttcacgcacatgcctacttatacttgttggtcgcaaagaattcgcatttctagggaagccaagcaacgcatcgctgaggcaatcaccgatgcccaccatgaattagcgcatgctcccaagtatttggtgcaggtgattttcaatgaggtggagcctgattcttatttcattgcggcgcagtcggcgtcggaaaaccacatttgggtccaagcaacgattcgttcggggcgtacagagaagcaaaaagaggaacttctgcttcggctgacacaagagatcgcgctgattcttgggatccccaatgaagaagtatgggtatatataccggagattcctggttccaatatgacggaatatggccgtctcctcatggaacctggcgaagaggagaagtggtttaattcgcttcccgaaggcctgcgggaaaggttgaccgagctagaaggatcgtcagaatagctctcgaataggccatttct

SEQ ID NO: 258 - protein, 149 aa, Corynebacterium glutamicum
MPTYTCWSQRIRISREAKQRIAEAITDAHHELAHAPKYLVQVIFNEVEPDSYFIAAQSASENHIWVQATIRSGRTEKQKEELLLRLTQEIALILGIPNEEVWVYIPEIPGSNMTEYGRLLMEPGEEEKWFNSLPEGLRERLTELEGSSE

SEQ ID NO: 259 - DNA, 1083 bp, Corynebacterium glutamicum
  CDS (101)..(1060): RXN01466
aatccatgatcccaaactacctcaaagcgcttgtaggctaagacttatggatacacaacgcggctcattgcggggaaaagctcataaagcaaggctaaagatgacgccaaatggtcgcaggcaactcctcctggagcgtggcgcagcatttagcaaaaaccgtaccccgggtctaaaacacgtcgaccgccacaccatcgtggactccgacggcctcagcatccacacgtacatggttggccatgccgaaaatgccacggcaacggtcgtgttcatccacggcttcaccctcgccgccgaagtgtattacatgcaggtcgactacctacaaaccttttacccaaatattaaaagcgtgcttatcgacgcccgcggccacggcgccaccggccagatccgcccagagctctgcaccatcgaaggaacagcgaacgatgttctcgcagccatccacgaacacgcaccgaccggcccgctcattttggttgggcattccctcggcggactcacggcacttaacctggttaaacgggcagatcactcacttcggaagaggatcgtcggcatggttctagtcgccacatcgatcgaatcattatccacccaaggtctaccacaagtcctggcatcaccccttgccgacaacatcaaaaacgccgtcgaagcagcccccaacgatgcccaaaaattccgccaatacgccaccacatttctagcccccaccctggccaccgcagtcttccaacgagacacaaacgatgaagtcatcgatttccacgccgccatgatccacgaaacccccttggataccttcgtcggtttcttcgacgacctccaagaacacgacgaactcgatgccgcaccagcattggaaggcctcaaaggctacgtccttgccggcgaattagatgatgtcaccccaattagccaagccgaccgcatctgcgaagtctggcccggcgcacgccttcaaatcgcagaaggagcaggtcatatgcttccgcttgaagcgccaggaatcctcaataatgcgatcggcaacattttggacgggctgggctgaggaacctggttcgggcgtgg

SEQ ID NO: 260 - protein, 320 aa, Corynebacterium glutamicum
MTPNGRRQLLLERGAAFSKNRTPGLKHVDRHTIVDSDGLSIHTYMVGHAENATATVVFIHGFTLAAEVYYMQVDYLQTFYPNIKSVLIDARGHGATGQIRPELCTIEGTANDVLAAIHEHAPTGPLILVGHSLGGLTALNLVKRADHSLRKRIVGMVLVATSIESLSTQGLPQVLASPLADNIKNAVEAAPNDAQKFRQYATTFLAPTLATAVFQRDTNDEVIDFHAAMIHETPLDTFVGFFDDLQEHDELDAAPALEGLKGYVLAGELDDVTPISQADRICEVWPGARLQIAEGAGHMLPLEAPGILNNAIGNILDGLG

SEQ ID NO: 261 - DNA, 1137 bp, Corynebacterium glutamicum
  CDS (101)..(1114): RXN01145
taatgtagttgtctgcccaagcgagttaaactcccacgatttacagtggggggcagacatcttttcaccaaaatttttacgaaaggcgagattttctcccatggctattgaactgctttatgatgctgacgctgacctctccttgatccagggccgtaaggttgccatcgttggctacggctcccagggccacgcacactcccagaacctccgcgattctggcgttgaggttgtcattggtctgcgcgagggctccaagtccgcagagaaggcaaaggaagcaggcttcgaggtcaagaccaccgctgaggctgcagcttgggctgacgtcatcatgctcctggctccagacacctcccaggcagaaatcttcaccaacgacatcgagccaaacctgaacgcaggcgacgcactgctgttcggccacggcctgaacattcacttcgacctgatcaagccagctgacgacatcatcgttggcatggttgcgccaaagggcccaggccacttggttcgccgtcagttcgttgatggcaagggtgttccttgcctcatcgcagtcgaccaggacccaaccggaaccgcacaggctctgaccctgtcctacgcagcagcaatcggtggcgcacgcgcaggcgttatcccaaccaccttcgaagctgagaccgtcaccgacctcttcggcgagcaggctgttctctgcggtggcaccgaggaactggtcaaggttggcttcgaggttctcaccgaagctggctacgagccagagatggcatacttcgaggttcttcacgagctcaagctcatcgttgacctcatgttcgaaggtggcatcagcaacatgaactactctgtttctgacaccgctgagttcggtggctacctctccggcccacgcgtcatcgatgcagacaccaagtcccgcatgaaggacatcctgaccgatatccaggacggcaccttcaccaagcgcctcatcgcaaacgttgagaacggcaacaccgagcttgagggccttcgtgcttcctacaacaaccacccaatcgaggagaccggcgctaagctccgcgacctcatgagctgggtcaaggttgacgctcgcgcagaaaccgcttaagtttcacccctttgacggct

SEQ ID NO: 262 - protein, 338 aa, Corynebacterium glutamicum
MAIELLYDADADLSLIQGRKVAIVGYGSQGHAHSQNLRDSGVEVVIGLREGSKSAEKAKEAGFEVKTTAEAAAWADVIMLLAPDTSQAEIFTNDIEPNLNAGDALLFGHGLNIHFDLIKPADDIIVGMVAPKGPGHLVRRQFVDGKGVPCLIAVDQDPTGTAQALTLSYAAAIGGARAGVIPTTFEAETVTDLFGEQAVLCGGTEELVKVGFEVLTEAGYEPEMAYFEVLHELKLIVDLMFEGGISNMNYSVSDTAEFGGYLSGPRVIDADTKSRMKDILTDIQDGTFTKRLIANVENGNTELEGLRASYNNHPIEETGAKLRDLMSWVKVDARAETA

SEQ ID NO: 263 - DNA, 487 bp, Corynebacterium glutamicum
  CDS (101)..(487): RXN03088
tcatggcaccgggacctggcatcgtagctaaggtttcttttgatgatttctccgacgtcaccggcggcgatgaactcctcgaattggaggcaaagaactaatgggtcaaacccgcatcatttccggcgacgcacgcggccgcaagatcgaagtaccaccagcaggtacccgccccacctctgaccgcgcacgcgaaggtctcttctcctcactgcaggtccgtttcggatttgagggccagcgcgtcctcgacatttttgccggctccggcgcactcggattggaagctgcctccaggggtgccgatgaggtagttctggtcgagtcgaatcctaaggccgtagaggtaattcgacggaatgtggacgtcgtaaagcatcctcgcgtaaccgtcgcagagatgaaagcatccacctaccttgcgtccgcacccgataagtttttcacgatggtgctcgccgacccgccctatgagcttgcgacgacg

SEQ ID NO: 264 - protein, 129 aa, Corynebacterium glutamicum
MGQTRIISGDARGRKIEVPPAGTRPTSDRAREGLFSSLQVRFGFEGQRVLDIFAGSGALGLEAASRGADEVVLVESNPKAVEVIRRNVDVVKHPRVTVAEMKASTYLASAPDKFFTMVLADPPYELATT

SEQ ID NO: 265 - DNA, 639 bp, Corynebacterium glutamicum
  CDS (101)..(616): RXN02952
tccaaaccgctgtttctgctcgtggcgaatcctggatattgaagtaattgaaatccgagacctgatctttgatctcgctacctcattcacaagcgccggcatgagctccccagcacttgacgctgcaaaacagcgccttgctgaatccgatggcctgatcgctgttaccccagtatttaccgcgagctactccggcatcttcaagatgttctttgatgtcctggaccccaagaccattgtgggtctgcccaccatcattgcggcatctgctggaacggcacgccactcattggttctcgaccacgccatccgaccactgtttacctacttgcgagcagttgtcgtacccaccggcgtgttcgcagccacggaagatttcggcactgaagctggcgcagacattgaacgtcgcgtgaaccgcgcagctggcgaattagcgacactcatgttgcaggattactccagtgtgcaaggccttgggggcgcaaccgcgaaccaagacgctgacctttccttccgtcgcaccactggcgtgaccccgggagagaacttcagcagctttgccgatctttctcaaaggacacgacggaaacggctaaattcgcggatctccgtttaaggcattgaagcatttggagg

SEQ ID NO: 266 - protein, 172 aa, Corynebacterium glutamicum
MSSPALDAAKQRLAESDGLIAVTPVFTASYSGIFKMFFDVLDPKTIVGLPTIIAASAGTARHSLVLDHAIRPLFTYLRAVVVPTGVFAATEDFGTEAGADIERRVNRAAGELATLMLQDYSSVQGLGGATANQDADLSFRRTTGVTPGENFSSFADLSQRTRRKRLNSRISV

SEQ ID NO: 267 - DNA, 1044 bp, Corynebacterium glutamicum
  CDS (101)..(1021): RXN00513
cacagcgtacgcacgagcttgaggatctttcagaactcaacattgaattggatgccgatattttggccaaggctcctgtgattccggaaggactgttctgatggcgggtttgttttcctctgctgttgcaccaacggagcgtcgaaaagcattacgcgcggcactggctgcgcctgaaattgcccgcatgcctggtgcattctccccgctggcggcgcgcgcaatccaggaagccggatttgaaggcgtgtacgtctcgggcgccgtcgtggcggctgaccttgcattgccggatatcggcttgaccacattgaccgaagtggcgcaccgctcccggcagatcgcacgcgtgacagacttgcccgtgctggtcgacgccgacaccggcttcggcgaacccatgtccgcagcgcgcaccgtctccgaactcgaagatgcaggtgtcgcgggctgccacctggaagatcaagtcaaccccaaacgctgtgggcacctggacggaaaagaagtagtgggcacggacatcatggttcgtcgcatcgccgcagctgtcaacgagcgtcgcgatgagcaattcgtcatctgcgctcgcaccgacgccgcgggagtggaaggcatcgactccgcgatcgagcgcgccaaagcttacgcggatgccggcgccgacatgatcttcaccgaagcgctgtacagccctgcagattttgaaaaattccgcgcggccgtcgacattccgctgctggccaacatgacggaatttggcaaaaccgaacttctgcccgcgcagcttctggaagacatcggatacaacgcagtgatctacccagtgaccctgctgcgcattgcgatgggacaggtcgaacaagctctcggcgacattgcaaacaccggaatccaaaccgactgggtcgaccggatgcaacaccgatccaggctgtatgagctgctgcgctacaacgagtacaacgctttcgaccagcaagtattcacctattccgctgacagctacaagcccatcttctaacccgcctatatataaggagt

SEQ ID NO: 268 - protein, 307 aa, Corynebacterium glutamicum
MAGLFSSAVAPTERRKALRAALAAPEIARMPGAFSPLAARAIQEAGFEGVYVSGAVVAADLALPDIGLTTLTEVAHRSRQIARVTDLPVLVDADTGFGEPMSAARTVSELEDAGVAGCHLEDQVNPKRCGHLDGKEVVGTDIMVRRIAAAVNERRDEQFVICARTDAAGVEGIDSAIERAKAYADAGADMIFTEALYSPADFEKFRAAVDIPLLANMTEFGKTELLPAQLLEDIGYNAVIYPVTLLRIAMGQVEQALGDIANTGIQTDWVDRMQHRSRLYELLRYNEYNAFDQQVFTYSADSYKPIF

SEQ ID NO: 269 - DNA, 957 bp, Corynebacterium glutamicum
  CDS (101)..(934): RXN01152
agtgaaggatctgatgtggtttgaacaagccctggaagcctatctggtaaattaacgccgagttcaatcaagacaagcacacagaagaaagtgagggctcatgccctactcaggtccgttccaagcaggcgaccgcgttcagctcaccgacgctaaacgccgccatttcaccatcattttggaaccaggaaccacctaccacacccaccgtggacaaatcgcacacgatgacatcatcggcgccgatgagggcactgttgtccactccaccatgggctctgattacttgtgcttccgtcacctcatggttgatcacgtgctgagcatgcctcgtggcgctgcagttatttatccaaaggactctgcacagattctggtcgagggcgatattttccctggcgcccgagttctggaagctggcgctggttccggtgcactgtccatggcgctgcttcgtgcagtgggtgaaaagggcaatgtcatctcctacgaaatccgtgaggatcacctggagtacgcagtctccaacgtggaggagtacttcggtgagcgtccagcaacctgggatccacgtcttggtgacctgaaagaagtcaccgttgaggatctcggcggacctgttgaccgcatcatcttggatatgcttgagccgtgggaaatgctggagacctgcaaggatcttctcatccctggtggtgtgtttatgacgtatgtggcgaccgtgccacagctgatgaaggtcatggaaggcatccgcgagcaaaaatgcttcacggagccacgcgcgtgggaatctttggttcgtgattggaaggtggagggcttggcaacacgccctgagcaccgcatgaatgcccacaccgcgttcttggtgttgaccaggcgtttggctgatggcgtggagcctcctcgtccgcagcgtaaggcacgtcgataaaaagacctagttggagggcg

SEQ ID NO: 270 - protein, 278 aa, Corynebacterium glutamicum
MPYSGPFQAGDRVQLTDAKRRHFTIILEPGTTYHTHRGQIAHDDIIGADEGTVVHSTMGSDYLCFRHLMVDHVLSMPRGAAVIYPKDSAQILVEGDIFPGARVLEAGAGSGALSMALLRAVGEKGNVISYEIREDHLEYAVSNVEEYFGERPATWDPRLGDLKEVTVEDLGGPVDRIILDMLEPWEMLETCKDLLIPGGVFMTYVATVPQLMKVMEGIREQKCFTEPRAWESLVRDWKVEGLATRPEHRMNAHTAFLVLTRRLADGVEPPRPQRKARR

SEQ ID NO: 271 - DNA, 2025 bp, Corynebacterium glutamicum
  CDS (101)..(2002): RXN00787
ccagcccgcccaataaataatttctctcttctaattgcggagcctcatatattgagtacggtattttgaaacaccttcagccccctttttaggagccacagtgtctcagcctctcagcaagcgtctcagcatacgaaaagcactcgccagcgccttcatagttgcgctggcgttttcgctttccccagtagccaaagcccaagccaatgaaactccgacgatgatcgtgttggacaattcaggctccatgacagctcaagatgccggcggacagacccgtatcgatgcagcaaaacaagcctccactcagttaattaatgacatctccgaccgcaccgacgtaggtctgacctactacggcggaaacaccggcgaaacagaagcagacgttgagatgggatgccaagacgtcaccatccttggcggcccctcccgaggaaatgcagacaccttaattgacacgatcaacagcctgcagcctcgaggcttcacccccatcggcaaagcactcaccgataccgccgccgagctccccgaaggcggaaacattgtgttggtctccgatggcatcgccaactgcaccccaccggatgtctgcgaagtagcccaagaactggctcaaagtggaatcaacctggttatcaacaccatcggactaaatgttgatccagcagcgcgcgaagaactggagtgcatcgctggagtcggtggtggcacttacgcggatgcttccgacgcgcagagccttaccgatgcgctgacacgagccgccagtaggcaatacaactcttacacctccgatgtgacaaaaattgatggggcatcggaacaaagcgcagccgtagaaattgatgaggatacagaactattcctcaccgacctgccacaagaatcccgcttttggaaaatccctgtagagccaggtgaaaccatctcagtttctgccaacacagttaccgacccaacagtactcaccatggggcaaggcggaatcaagcttgaagcccaactccatactgaagaggctccacaatacggcctgcgtggtcggtgcactcgggtctcatttgataatttcaagcccggccttggtgtacgcggaatccaaaacgcgtccgttgcatcaaaagaagtgggcaccaacaactgtgacaccgatgccatctacctcgaaatttctagaagcggagattacctcaacgggcaggacattccaacggaaatcaccatcgagcgcttcggaaaagtagatgaatcaacaatcggaaatgtcacagaggaacatagctccgtcgatcttaccgaggctgcagcatcagaggcacaccctgtcacacctggccagtggttcacatcggccgctgatctagatcccgcaggtgagaaagtctcctccatcatcgttccaggagaaacccacttctatgcgctgcctgtcgactacggccaagaactgcgcgcagctgtagaaacaacttttgaccaaatcgacagttccgcgcttggcacgcatctttatatccaagcgttcagcccaaaccgggcagagatagagctcaccaatagagatacgtcatatgcggacgacaacgggctcaaaacttttggattcttcaccccagtgagtgcagcaaatttgttcgagaaaagttctcaaggcatatcgctaaggagcccatggcaaggtggcacccaatacctcgcagtgacatacctaccaagtggtcaagatgaagatgtatccgcaactgatcagctgcccacattggaatatgaactcgtggcagaagcgtttggagaccctgttgacccaccggttttcgcttcattgacgggagcaaccccaagcacctccacccccccatcagatgttgcggaagatgaacaaatctccgaggcaacagaagaagactcaagcagtttccccatcgtgtggattgggctgggtgtcattggcttaggcataatcattggtttgatctttgcgctgagaagaaagaattaagccctaaaagataaagagtc

SEQ ID NO: 272 - protein, 634 aa, Corynebacterium glutamicum
VSQPLSKRLSIRKALASAFIVALAFSLSPVAKAQANETPTMIVLDNSGSMTAQDAGGQTRIDAAKQASTQLINDISDRTDVGLTYYGGNTGETEADVEMGCQDVTILGGPSRGNADTLIDTINSLQPRGFTPIGKALTDTAAELPEGGNIVLVSDGIANCTPPDVCEVAQELAQSGINLVINTIGLNVDPAAREELECIAGVGGGTYADASDAQSLTDALTRAASRQYNSYTSDVTKIDGASEQSAAVEIDEDTELFLTDLPQESRFWKIPVEPGETISVSANTVTDPTVLTMGQGGIKLEAQLHTEEAPQYGLRGRCTRVSFDNFKPGLGVRGIQNASVASKEVGTNNCDTDAIYLEISRSGDYLNGQDIPTEITIERFGKVDESTIGNVTEEHSSVDLTEAAASEAHPVTPGQWFTSAADLDPAGEKVSSIIVPGETHFYALPVDYGQELRAAVETTFDQIDSSALGTHLYIQAFSPNRAEIELTNRDTSYADDNGLKTFGFFTPVSAANLFEKSSQGISLRSPWQGGTQYLAVTYLPSGQDEDVSATDQLPTLEYELVAEAFGDPVDPPVFASLTGATPSTSTPPSDVAEDEQISEATEEDSSSFPIVWIGLGVIGLGIIIGLIFALRRKN

SEQ ID NO: 273 - DNA, 576 bp, Corynebacterium glutamicum
  CDS (101)..(553): RXN01302
tggggctgcgtggtgttcttcatcatcgccaccgctttgacctggatctactacgcccgcccgaacgctccattcccgggataaaccgaaaggccaatccatgactacaactacttcttctgggaagtcttctgaaaagatcaaccccctcttcaagctcggcagtttcctaagaaaaggcaccgtcggttctgaaggccagcagattttccttcagggcggacgccaagccgatgtgttttatcgcaaccgatgggctttcgataaagtcgtgcgctccacacatggcgtgaactgcacgggctcctgctcgtggaaagtgtatgtaaaagacggtgtgatcacctgggaatcccaggcagtggattacccaactaccggtgcggatatgcccgacaatgaaccacgtggctgccctcgtggtgcatcattttcctggtacacctactccccaacccgcatccgctacccatacatcggtggcgtgctagttgatatgtccgcgaagccaaggaacgcctgggcgatccggtgctggcgtggcgcgacattgtagaaaccccagaaaagcgcaaa

SEQ ID NO: 274 - protein, 151 aa, Corynebacterium glutamicum
MTTTTSSGKSSEKINPLFKLGSFLRKGTVGSEGQQIFLQGGRQADVFYRNRWAFDKVVRSTHGVNCTGSCSWKVYVKDGVITWESQAVDYPTTGADMPDNEPRGCPRGASFSWYTYSPTRIRYPYIGGVLVDMSAKPRNAWAIRCWRGATL

SEQ ID NO: 275 - DNA, 466 bp, Corynebacterium glutamicum
  CDS (101)..(466): FRXA01302
tggggctgcgtggtgttcttcatcatcgccaccgctttgacctggatctactacgcccgcccgaacgctccattcccgggataaaccgaaaggccaatccatgactacaactacttcttctgggaagtcttctgaaaagatcaaccccctcttcaagctcggcagtttcctaagaaaaggcaccgtcggttctgaaggccagcagattttccttcagggcggacgccaagccgatgtgttttatcgcaaccgatgggctttcgataaagtcgtgcgctccacacatggcgtgaactgcacgggctcctgctcgtggaaagtgtatgtaaaagacggtgtgatcacctgggaatcccaggcagtggattacccaactaccggtgcggatatgcccgacaatgaaccacgtggctgccctcgtggtgcatcattttcctggtacacctactccccaaccggcatccgc

SEQ ID NO: 276 - protein, 122 aa, Corynebacterium glutamicum
MTTTTSSGKSSEKINPLFKLGSFLRKGTVGSEGQQIFLQGGRQADVFYRNRWAFDKVVRSTHGVNCTGSCSWKVYVKDGVITWESQAVDYPTTGADMPDNEPRGCPRGASFSWYTYSPTGIR

SEQ ID NO: 277 - DNA, 2503 bp, Corynebacterium glutamicum
  CDS (101)..(2503): RXN01308
tttcctggtacacctactccccaacccgcatccgctacccatacatcggtggcgtgctagttgatatgtccgcgaagccaaggaacgcctgggcgatccggtgctggcgtggcgcgacattgtagaaaccccagaaaagcgcaaagcatatgtatcccagcggggcaaaggtggcctcatccgcgttcagtatgaggaagccatggagattgctgcggcagcccatgtgtacaccatccgccaatacggccccgaccgcattcatggattcaccgttattcccgcaatgtcgcaggtgtcttacggtgctggtactcgcttcttgcagatgatcggcggagtggcgctgtccttctacgattggtacgccgacctcccaccagcatcaccacaaactttcggcgatcaaactgacgttccggaatctggcgactggtacaactccagctacctcatgatgtggggttccaacattccggtgacccgcacgcctgactcccacttcatggtggaagcccgctacaagggcaccaaggttgttgtggtttccccggatttcgctgactccaccaaatttgctgatgaatgggcacgcatccaccctggtactgacggcgcactcgcctttgccatgggccatgtgatcttgaaggaattccatgttgacaagaagacgccgtacttcatggactacatgcgcaaatacacggactctcctttcctcgtggaattagatgagcacggcgatggcacctacaccccaggtaaattcctcactgcagaccgcgcagctgatatctccccagcgcttgccgccactccaaatgccacccaccgtctccttgtgctgcaaaaagatggctcagttgtagatcccggtggcactgtcgcggaccgttggggtgaagaaggcatgggtaagtggaatctgcgcttagacggcgtagatccagtgatgactattgcagatgtacagactgacaccgaaactgcggaagtcctcttcccccgcttcgatctcccagcaactgccacccaagaaggccccattggtgctggcaccatcagccggggcgttcccaccatcacgttgaatggccgaaagtacaccactgtctttgatgtgttgctcgcacactacggtgtgaaccgcgaagagctcaaccttcctggtgagtggcctaaggatttccaggatccagtcatgggtactcctgcgtggcaggaagagctcacgggtgttcctgctaatcaggcgattcgtttgggtcgggaatttgctcagaatgctgatgattccaagggccgttcccagatcatcatgggtgctggtgtgaaccactacttccatgcggattctatttatcgcacattcttggcgctgacctctatgtgtggcacccaaggtgttaacggtggcggttgggctcactacgttggtcaggagaaactccgtccaatgaatggttgggcacagtatgcctttgctacagactggcagcgtccaccacgtcagatgatcaccactggtttctactacctcaccacggatcagtggaggtatgacaacactcgtgctaatcgtctggcttccccactggctaatcgtggcaccgtgggtgacaaaatgacggcggataccttggtggaatccatgaaacgtggatggatgccgtcattcccgcaattcaaccgcaatcccctcatcttgagccaggaggcggaagaaaagggcgtgtctgtttctgaccatattgttcagcagctcaccgatggtgacttgcagttcgcctgcgaggatccggatgcaccggaaaactggccacgcattctgcttaactggcgcacaaacctaatgggctcttcagctaagggcacggagtttttcttgcgccatatgttgggtgtggattctgatgcatctgctgaagaaaacgcgccggaggatcgtccaagttccattgtgtggagggatgaggctccggaaggaaagctcgatttgatgctgaccacggatttccgcaacacttccaccaccttggtctcggatatcgtgctgccggcagccacctggtatgagaagcatgatttgtccaccacggatatgcaccccttcatccactcgttcaatgctgcgatcaacccaccgtgggagacgcgtactgactgggaggtcttccacgatctcaccaaagaattctcctcacaggcagcaacctggttgggcacccaaaccgatgtgatcaccgcaccgattgcccatgactccccggatgagctcaatatgcctggcggtatcgtgccagatattgatgaggtcgggctgatccctggcaagacgatggccaagatcatcccggtggaacgtgattactccaaggtgtatgaaaagtggacacacttgggaccactcaccgccaaagcgggtaccggaacccacggcactgcgtttaacgtgaccaagcaaaccgaggagctggcgctgatcaacggcacctccatc

SEQ ID NO: 278 - protein, 801 aa, Corynebacterium glutamicum
VLAWRDIVETPEKRKAYVSQRGKGGLIRVQYEEAMEIAAAAHVYTIRQYGPDRIHGFTVIPAMSQVSYGAGTRFLQMIGGVALSFYDWYADLPPASPQTFGDQTDVPESGDWYNSSYLMMWGSNIPVTRTPDSHFMVEARYKGTKVVVVSPDFADSTKFADEWARIHPGTDGALAFAMGHVILKEFHVDKKTPYFMDYMRKYTDSPFLVELDEHGDGTYTPGKFLTADRAADISPALAATPNATHRLLVLQKDGSVVDPGGTVADRWGEEGMGKWNLRLDGVDPVMTIADVQTDTETAEVLFPRFDLPATATQEGPIGAGTISRGVPTITLNGRKYTTVFDVLLAHYGVNREELNLPGEWPKDFQDPVMGTPAWQEELTGVPANQAIRLGREFAQNADDSKGRSQIIMGAGVNHYFHADSIYRTFLALTSMCGTQGVNGGGWAHYVGQEKLRPMNGWAQYAFATDWQRPPRQMITTGFYYLTTDQWRYDNTRANRLASPLANRGTVGDKMTADTLVESMKRGWMPSFPQFNRNPLILSQEAEEKGVSVSDHIVQQLTDGDLQFACEDPDAPENWPRILLNWRTNLMGSSAKGTEFFLRHMLGVDSDASAEENAPEDRPSSIVWRDEAPEGKLDLMLTTDFRNTSTTLVSDIVLPAATWYEKHDLSTTDMHPFIHSFNAAINPPWETRTDWEVFHDLTKEFSSQAATWLGTQTDVITAPIAHDSPDELNMPGGIVPDIDEVGLIPGKTMAKIIPVERDYSKVYEKWTHLGPLTAKAGTGTHGTAFNVTKQTEELALINGTSI

SEQ ID NO: 279 - DNA, 765 bp, Corynebacterium glutamicum
  CDS (85)..(765): FRXA01307
ttccccaacccgcatccgctacccatacatcggtggcgtgctagttgatatgtccgcgaagccaaggaacgcctgggcgatccggtgctggcgtggcgcgacattgtagaaaccccagaaaagcgcaaagcatatgtatcccagcggggcaaaggtggcctcatccgcgttcagtatgaggaagccatggagattgctgcggcagcccatgtgtacaccatccgccaatacggccccgaccgcattcatggattcaccgttattcccgcaatgtcgcaggtgtcttacggtgctggtactcgcttcttgcagatgatcggcggagtggcgctgtccttctacgattggtacgccgacctcccaccagcatcaccacaaactttcggcgatcaaactgacgttccggaatctggcgactggtacaactccagctacctcatgatgtggggttccaacattccggtgacccgcacgcctgactcccacttcatggtggaagcccgctacaagggcaccaaggttgttgtggtttccccggatttcgctgactccaccaaatttgctgatgaatgggcacgcatccaccctggtactgacggcgcactcgcctttgccatgggccatgtgatcttgaaggaattccatgttgacaagaagacgccgtacttcatggactacatgcgcaaatacacggactctcctttcctcgtggaattagatgagcacggcgatggcacctacaccccaggtaaattcctcactgca

SEQ ID NO: 280 - protein, 227 aa, Corynebacterium glutamicum
VLAWRDIVETPEKRKAYVSQRGKGGLIRVQYEEAMEIAAAAHVYTIRQYGPDRIHGFTVIPAMSQVSYGAGTRFLQMIGGVALSFYDWYADLPPASPQTFGDQTDVPESGDWYNSSYLMMWGSNIPVTRTPDSHFMVEARYKGTKVVVVSPDFADSTKFADEWARIHPGTDGALAFAMGHVILKEFHVDKKTPYFMDYMRKYTDSPFLVELDEHGDGTYTPGKFLTA

SEQ ID NO: 281 - DNA, 1206 bp, Corynebacterium glutamicum
  CDS (1)..(1206): FRXA01308
gccgccactccaaatgccacccaccgtctccttgtgctgcaaaaagatggctcagttgtagatcccggtggcactgtcgcggaccgttggggtgaagaaggcatgggtaagtggaatctgcgcttagacggcgtagatccagtgatgactattgcagatgtacagactgacaccgaaactgcggaagtcctcttcccccgcttcgatctcccagcaactgccacccaagaaggccccattggtgctggcaccatcagccggggcgttcccaccatcacgttgaatggccgaaagtacaccactgtctttgatgtgttgctcgcacactacggtgtgaaccgcgaagagctcaaccttcctggtgagtggcctaaggatttccaggatccagtcatgggtactcctgcgtggcaggaagagctcacgggtgttcctgctaatcaggcgattcgtttgggtcgggaatttgctcagaatgctgatgattccaagggccgttcccagatcatcatgggtgctggtgtgaaccactacttccatgcggattctatttatcgcacattcttggcgctgacctctatgtgtggcacccaaggtgttaacggtggcggttgggctcactacgttggtcaggagaaactccgtccaatgaatggttgggcacagtatgcctttgctacagactggcagcgtccaccacgtcagatgatcaccactggtttctactacctcaccacggatcagtggaggtatgacaacactcgtgctaatcgtctggcttccccactggctaatcgtggcaccgtgggtgacaaaatgacggcggataccttggtggaatccatgaaacgtggatggatgccgtcattcccgcaattcaaccgcaatcccctcatcttgagccaggaggcggaagaaaagggcgtgtctgtttctgaccatattgttcagcagctcaccgatggtgacttgcagttcgcctgcgaggatccggatgcaccggaaaactggccacgcattctgcttaactggcgcacaaacctaatgggctcttcagctaagggcacggagtttttcttgcgccatatgttgggtgtggattctgatgcatctgctgaaaaaaacgcgccggaggatcgtccaagttccattgtgtggagggatgaagcttccgaagggaagctcgatttgatgctgaccacggat

SEQ ID NO: 282 - protein, 402 aa, Corynebacterium glutamicum
AATPNATHRLLVLQKDGSVVDPGGTVADRWGEEGMGKWNLRLDGVDPVMTIADVQTDTETAEVLFPRFDLPATATQEGPIGAGTISRGVPTITLNGRKYTTVFDVLLAHYGVNREELNLPGEWPKDFQDPVMGTPAWQEELTGVPANQAIRLGREFAQNADDSKGRSQIIMGAGVNHYFHADSIYRTFLALTSMCGTQGVNGGGWAHYVGQEKLRPMNGWAQYAFATDWQRPPRQMITTGFYYLTTDQWRYDNTRANRLASPLANRGTVGDKMTADTLVESMKRGWMPSFPQFNRNPLILSQEAEEKGVSVSDHIVQQLTDGDLQFACEDPDAPENWPRILLNWRTNLMGSSAKGTEFFLRHMLGVDSDASAEKNAPEDRPSSIVWRDEASEGKLDLMLTTD

SEQ ID NO: 283 - DNA, 824 bp, Corynebacterium glutamicum
  CDS (1)..(801): RXN01309
attgcagaccacgaaggtacccacatcaattgggacatggtcaaagaacgttccgccgaggtgatcacctcaccggagtggactggttccaagaaggacggacgtcgctacaccgcgttttccatcaacattgaatacgacaagccgtggcacaccctgtctggtcgcatgcactactacctcgaccacgattggtttattgattacggcgagcagttgccaatctttaggccaccgttggacaagatccacatcaatggtgaggtcggccctggccagtcggtcacaggcaccgacggcgaaccagaagtaaccgtgcgttatctgaccacccacaacaagtggtcgattcactcgcagtactacgacaatctgcatgtgctttctatttctcgtggcggccaggtgatctggatgtccaacaaggatgcagagaaactcggtatcgctgacaacgattggatcgaggcttataaccgcaacggcgttgtttctgctcgtgcgattgtctcccaccgcattcctgaaggcaccgtgtttatgaaccacgcgcaggaacgcaccgctggcaccccgctgaacgagaagtctggcaggcgcggcggaactcacaactctcttactcgaatcatgattaagccggtccatgttgccggtggctacggccacttaacctatggcttcaactacatcggccaaccggaaataaccgcgatgaggtcaccagaattcgtcgccgctcccaggaggtgcagtactaatgaaggtcatggctcagatcgcaatgatcatgaacttggataagtgcattggctgccacacgt

SEQ ID NO: 284 - protein, 267 aa, Corynebacterium glutamicum
IADHEGTHINWDMVKERSAEVITSPEWTGSKKDGRRYTAFSINIEYDKPWHTLSGRMHYYLDHDWFIDYGEQLPIFRPPLDKIHINGEVGPGQSVTGTDGEPEVTVRYLTTHNKWSIHSQYYDNLHVLSISRGGQVIWMSNKDAEKLGIADNDWIEAYNRNGVVSARAIVSHRIPEGTVFMNHAQERTAGTPLNEKSGRRGGTHNSLTRIMIKPVHVAGGYGHLTYGFNYIGQPEITAMRSPEFVAAPRRCSTNEGHGSDRNDHELG

SEQ ID NO: 285 - DNA, 692 bp, Corynebacterium glutamicum
  CDS (1)..(669): FRXA01309
attgcagaccacgaaggtacccacatcaattgggacatggtcaaagaacgttccgccgaggtgatcacctcaccggagtggactggttccaagaaggacggacgtcgctacaccgcgttttccatcaacattgaatacgacaagccgtggcacaccctgtctggtcgcatgcactactacctcgaccacgattggtttattgattacggcgagcagttgccaatctttaggccaccgttggacaagatccacatcaatggtgaggtcggccctggccagtcggtcacaggcaccgacggcgaaccagaagtaaccgtgcgttatctgaccacccacaacaagtggtcgattcactcgcagtactacgacaatctgcatgtgctttctatttctcgtggcggccaggtgatctggatgtccaacaaggatgcagagaaactcggtatcgctgacaacgattggatcgaggcttataaccgcaacggcgttgtttctgctcgtgcgattgtctcccaccgcattcctgaaggcaccgtgtttatgaaccacgcgcaggaacccaccgctggcaccccgctgaacgagaagtctggcaggcgcggcggaactcacaactctcttactcgaatcatgattaaaacggtccatgttgccggtggctacggcacttaacctatggcttaactacatcg

SEQ ID NO: 286 - protein, 223 aa, Corynebacterium glutamicum
IADHEGTHINWDMVKERSAEVITSPEWTGSKKDGRRYTAFSINIEYDKPWHTLSGRMHYYLDHDWFIDYGEQLPIFRPPLDKIHINGEVGPGQSVTGTDGEPEVTVRYLTTHNKWSIHSQYYDNLHVLSISRGGQVIWMSNKDAEKLGIADNDWIEAYNRNGVVSARAIVSHRIPEGTVFMNHAQEPTAGTPLNEKSGRRGGTHNSLTRIMIKTVHVAGGYGT

SEQ ID NO: 287 - DNA, 807 bp, Corynebacterium glutamicum
  CDS (101)..(784): RXA02017
gcctgtggcacgggagctcccagcggcaaggtgagtctgacctcgtggaacgttggcgaacgccccgctgcgatgttcccaccaaggaaggactaggcggatgcgcacccatactggcaaaattccggatcactttgtgcctcgcatctccatgacggaggagcagcggcgcgtggtgttcatgctgaatagtttgctgttggattatccagaggagggattcgtcgacaagctaaatgccgtcgaggcgcagcttgatgtccttccgctccccgtcgcggcgcacgtggtcgagttccttgacgcggcacgcgtcgctgggctacgcgccatgcaggaagcctacgttgagacctttgaccagcgccgacgctgctcactgtttctcacctactacgctgtgggcgacacccggcagcgcggcacggcgatcctcaccttccgtcaaacgctgcaacagctcggatttgaatccgagcgcgacgaattgcccgaccacctctgcgtcgtgcttgaggccgcagcgcttgctgattcttcgcttttcgacgccgccacccaggtgttatcagctcaccgcgacggcatcgaagtgttgcgcgcagccctcgacaacctcgactcgccctacagatacctgatcatgtctttgtgccaggcattgccagaaatcgatgaagaaaccgccaacagctacatggagctcatccgcagcggtccaccagcagaaatggtgggcatcggcacgcctctaccgttccccacctcacaaccggacattcactaggacacactatgtcaaacttt

SEQ ID NO: 288 - protein, 228 aa, Corynebacterium glutamicum
MRTHTGKIPDHFVPRISMTEEQRRVVFMLNSLLLDYPEEGFVDKLNAVEAQLDVLPLPVAAHVVEFLDAARVAGLRAMQEAYVETFDQRRRCSLFLTYYAVGDTRQRGTAILTFRQTLQQLGFESERDELPDHLCVVLEAAALADSSLFDAATQVLSAHRDGIEVLRAALDNLDSPYRYLIMSLCQALPEIDEETANSYMELIRSGPPAEMVGIGTPLPFPTSQPDIH

SEQ ID NO: 289 - DNA, 1073 bp, Corynebacterium glutamicum
  CDS (1)..(1050): RXA02018
cgcatctgcgagcactgcctcaaccccacctgtgtgtcctcctgcccatccggtgctatgtacaaacgcgccgaagacggcatcgtgctggttgaccaggatcaatgccgtggctggcgcatgtgtgtttccggctgcccctacaaaaaggtctacttcaatcacaaatcgggcaaggccgaaaagtgtacgctgtgctatccgcgcctcgaggtcggccagccgaccgtgtgctccgagacgtgcgtgggtcgcttgcgctacttgggcgttttgctttacgacgccgaccgtgtcgctgaagtcgccgccacgccagacgaaaaggatcttttcgaagcccaaaagaccctcttcctagatccccacgacccacaggtgatcgccgacgcccaacgcaacggcatcccgcactcctggctcgaagctgcgcagaactctccaatttacgatctcatcttcaaatacgaggttgccctcccgcttcaccctgaataccgcaccttgccgatggtttggtacattccgccactaagccccatcgttgatgaggtgaccgcgtccggcaacgacggcgaagaccacaagatcctgctcaccgcgctgtccaccatgcgcatcccgctggaatacctggctggattgttcactgccggtgataccaggccggtggaaaaatccctccgacgcctagccgccatgcgatcatatatgcgcgatatcagtttgggccgcgaacctcaggaagaaatcgcagaggctgtcggaatgaccggcaaggtggtgcaggaaatgtatcgcatcctggccattgccaagtatgacgatcgctatgtcatccccaccgcctcccctgagaccccgcgcggaatttcttccctggatcctttcggcgatgtcgatccagcccgagccaccgagcagctcaacatcggtttgggcgaaggcgctccagaggcctgtggcacgggagctcccagcggcaaggtgagtctgacctcgtggaacgttggcgaacgccccgctgcgatgttcccaccaaggaaggactaggcggatgcgcacccatactg

SEQ ID NO: 290 - protein, 350 aa, Corynebacterium glutamicum
RICEHCLNPTCVSSCPSGAMYKRAEDGIVLVDQDQCRGWRMCVSGCPYKKVYFNHKSGKAEKCTLCYPRLEVGQPTVCSETCVGRLRYLGVLLYDADRVAEVAATPDEKDLFEAQKTLFLDPHDPQVIADAQRNGIPHSWLEAAQNSPIYDLIFKYEVALPLHPEYRTLPMVWYIPPLSPIVDEVTASGNDGEDHKILLTALSTMRIPLEYLAGLFTAGDTRPVEKSLRRLAAMRSYMRDISLGREPQEEIAEAVGMTGKVVQEMYRILAIAKYDDRYVIPTASPETPRGISSLDPFGDVDPARATEQLNIGLGEGAPEACGTGAPSGKVSLTSWNVGERPAAMFPPRKD

SEQ ID NO: 291 - DNA, 900 bp, Corynebacterium glutamicum
  CDS (101)..(877): RXA02016
acatggagctcatccgcagcggtccaccagcagaaatggtgggcatcggcacgcctctaccgttccccacctcacaaccggacattcactaggacacactatgtcaaactttgaaacgttcctctgggttgcctacccctggctgtgtatcgccgcctacatcatcggcatttcttggcgctggcgcgccgaccaattcggttggaccacccactcctcccaaatctacgaatccaaactcctccgcatcgcctccccactcttccactggggcatggtgttcgtggtgatcggccacctcatgggacttgccatccccaagagctggacccaagctgtaggaatttctgacgccgcttaccacctcatcgccaccatcccaggcaccattgccggcatcgctgcagtccttggactcatcggcttgattatccgtcgcgtgatcaacaaaaccgtcttcctgtccacctcacgctccgacaaagtgatgtatgtgctactcggcgctgcaattttgtccggtttcatcgccaccgtctccacccaggtcttcggcggcgcacacggctacgactaccgcgaaaccatctccccatgggtgcgccaactgctcatcttcaacgctcaaccagagctcatggctgatgtcccttgggaattcaaggtccacatcgtcgctggattcaccctcatcgcactgtggccattcacccgcctagtccacgcgttctccgcaccagttggatacgtcacccgcccctacgtggtctatcgcacccgcgacaccacctctgaaccggcacgccaaaacgtcgcctgggaaccgatccgctcggtcaaaaatcagctcgacaatgactcgaaatggcacggcgcctaaattcctcacaagccccctag

SEQ ID NO: 292 - protein, 259 aa, Corynebacterium glutamicum
MSNFETFLWVAYPWLCIAAYIIGISWRWRADQFGWTTHSSQIYESKLLRIASPLFHWGMVFVVIGHLMGLAIPKSWTQAVGISDAAYHLIATIPGTIAGIAAVLGLIGLIIRRVINKTVFLSTSRSDKVMYVLLGAAILSGFIATVSTQVFGGAHGYDYRETISPWVRQLLIFNAQPELMADVPWEFKVHIVAGFTLIALWPFTRLVHAFSAPVGYVTRPYVVYRTRDTTSEPARQNVAWEPIRSVKNQLDNDSKWHGA

SEQ ID NO: 293 - DNA, 813 bp, Corynebacterium glutamicum
  CDS (101)..(790): RXA00471
acgcatcaaatctgaaatcggcgaaggcaccgaagtggcaatcaccatggatgtgtagttggtcgtacgcgcgtgtcttcggggctgtaacctgaaaggcatggttgatgtgtttttggtcgatgaccactccgtgtttcgctccggcgtcaaagcagaactaggcaacgccgtcacagtagtcggcgaagcagggacggtggccgacgccgtagccggcatcaaggcaagcaaaccagaggtagtgcttctcgacgtccacatgcccgacggcggcggcctcgcagtgctccagcagatcaacgactccgatgtggacaccattttcttggcactcagtgtctctgatgctgcggaagatgtcatcgccatcatccgtggcggtgccaggggatacgtgaccaaatcaatctccggtgaagaactcatcgaagccatcaaccgcgtgaaatccggcgacgcattcttctcaccacgcctggcaggctttgtcctcgacgccttcgccgcccccgattccgcagctggcgcaggcattgtcgacgcacccgaaaaagacgccgccgtagaatccggaaaaatcctcgacgacccagttgtcgacgccctcacccgccgcgaactcgaagtcctccgcctactagcccgcggctacacctacaaagaaatcggcaaagaactgttcatttccgtcaaaaccgtggaaacccacgcctcaaacattctgcggaaaacccaacaatccaaccgccacgcgttgacccggtgggctcactcgagggatcttgactaatggcggctaaaaagagtggc

SEQ ID NO: 294 - protein, 230 aa, Corynebacterium glutamicum
MVDVFLVDDHSVFRSGVKAELGNAVTVVGEAGTVADAVAGIKASKPEVVLLDVHMPDGGGLAVLQQINDSDVDTIFLALSVSDAAEDVIAIIRGGARGYVTKSISGEELIEAINRVKSGDAFFSPRLAGFVLDAFAAPDSAAGAGIVDAPEKDAAVESGKILDDPVVDALTRRELEVLRLLARGYTYKEIGKELFISVKTVETHASNILRKTQQSNRHALTRWAHSRDLD

SEQ ID NO: 295 - DNA, 936 bp, Corynebacterium glutamicum
  CDS (101)..(913): RXA00133
gttacatcagatgaggatgccctatgggtgtacacatgcgacgggtgtattgcaggaggaaatttgaaggtggatacccagcggattaaagatgatgaagatgctattcgttcggcggctgacatcgctgaaaaccgcaacaggcatcccagtcaccatgttcgccactgtgttgcaggacaatcgcctgcaaattactcagtgggttgggttgcgtaccccggctctgcagaatctggtcattgaaccaggtgtgggcgttggtggacgcgtcgtcgcaacccgtcgtccggttggtgtgagtgattacaccagggcaaatgtcatttcacatgagaaggattccgcgattcaggatgagggccttcattccattgtcgcagttcccgtgatcgtgcaccgcgaaattcgtggcgttttgtatgttggcgttcactctgcggtgcgtctcggcgacactgttattgaagaagtcaccatgactgcgcgcacgttggaacaaaacctggcgatcaactccgcgcttcgccgcaatggcgttcctgatggtcgcggttccctcaaagctaaccgcgtgatgaatggggcggagtgggagcaggttcgttccactcattccaagctgcgcatgctggcaaatcgtgtgaccgatgaggatctgcgccgcgatttggaagagctttgcgatcagatggtcaccccagtccgcatcaagcagaccaccaagctgtccgcgcgtgagttggacgtgctggcttgtgtcgcgctcggtcacaccaacgtcgaagctgctgaagagatgggcatcggcgcggaaaccgtcaagagctacctgcgctcggtcatgcgcaagctcggcgcccacacgcgctacgaggcagtcaacgcagcacgccggatcggcgcactgccttaaaaagattttgctttacgacg

SEQ ID NO: 296 - protein, 271 aa, Corynebacterium glutamicum
MLFVRRLTSLKTATGIPVTMFATVLQDNRLQITQWVGLRTPALQNLVIEPGVGVGGRVVATRRPVGVSDYTRANVISHEKDSAIQDEGLHSIVAVPVIVHREIRGVLYVGVHSAVRLGDTVIEEVTMTARTLEQNLAINSALRRNGVPDGRGSLKANRVMNGAEWEQVRSTHSKLRMLANRVTDEDLRRDLEELCDQMVTPVRIKQTTKLSARELDVLACVALGHTNVEAAEEMGIGAETVKSYLRSVMRKLGAHTRYEAVNAARRIGALP

SEQ ID NO: 297 - DNA, 759 bp, Corynebacterium glutamicum
  CDS (101)..(736): RXA00650
aaggctagactaaagtacgattcatctgctcatcgatactcttgaaggcgcattttcattcgaaacgaagtgcgccattgggaaggacctagttcaaacaatgattcgcgtgctgcttgctgatgaccacgaaatcgtgaggctcggactccgagctgtgctggaaagcgccgaggacattgaagtggtgggcgaagtctccaccgccgaaggtgcggtgcaggcagcccaagaaggcggaatcgacgtcatcttgatggacctccgattcggccccggcgtccaaggaacccaggtttccacaggcgcagacgccaccgcagccatcaagcgaaacatcgataacccgccaaaagtcctggtcgtgaccaactacgacaccgacacagacatcctcggcgcaatcgaagccggcgcactgggctacctgctcaaagacgccccaccgagcgaactcctggcagcagtacgatccgcagcagaaggtgactccacactgtcacccatggttgcgaaccgcctgatgactcgcgtgcgcacccccaaaacctcactcaccccacgtgaactggaagttctcaagctggttgccggtggatcctccaaccgcgacattggccgtatcctcttcctctcagaagccacggtgaaatcccacctcgtgcacatctacgacaagctcggcgtgcggtcacgtacctccgctgtcgcagccgcacgtgagcaggggctgctgtagcgggggttgctgcaaggctt

SEQ ID NO: 298 - protein, 212 aa, Corynebacterium glutamicum
MIRVLLADDHEIVRLGLRAVLESAEDIEVVGEVSTAEGAVQAAQEGGIDVILMDLRFGPGVQGTQVSTGADATAAIKRNIDNPPKVLVVTNYDTDTDILGAIEAGALGYLLKDAPPSELLAAVRSAAEGDSTLSPMVANRLMTRVRTPKTSLTPRELEVLKLVAGGSSNRDIGRILFLSEATVKSHLVHIYDKLGVRSRTSAVAAAREQGLL

SEQ ID NO: 299 - DNA, 655 bp, Corynebacterium glutamicum
  CDS (24)..(632): RXA01189
cacctgcagaaaaggaagcttaaatgatttccatttccatcgccgacgacgaagccctgatcgcaagctccctggcaaccttgctcagcttggaacccgatttagacgtccgacctaccgcaggatccggtgaagaactcattgaaacgtgggcggatccaagcaaccgaaccgatgtatgcgtccttgaccttcaactcggaggcatcgacggcatcgacaccgccacccggctcatggaaaccaccccagatttggccgtgctcatcgtgaccagccacgccaggccccgacaactcaaacgcgcgcttgcagcaggtgttttaggattcttgcccaaaacatccaccgcagatgaattcgccaccgcaatccgcaccgttcacgctggacgacgctacatcgaccccgaactagccgccatgacgatcagcgccggtgaatccccattaaccaaccgtgaagaagaagtcctcgaactagcaggccaaggactaagcgccgaagaaattgcggtggcagcgcacctcgcgccgggaaccacccgcaactatttatcccaagctatgacaaaagtaggcgcgcagaatcgctttgaagcgttcacgcgcgccagggaattgggctggttgtagcttgtggcttatctcctatt

SEQ ID NO: 300 - protein, 203 aa, Corynebacterium glutamicum
MISISIADDEALIASSLATLLSLEPDLDVRPTAGSGEELIETWADPSNRTDVCVLDLQLGGIDGIDTATRLMETTPDLAVLIVTSHARPRQLKRALAAGVLGFLPKTSTADEFATAIRTVHAGRRYIDPELAAMTISAGESPLTNREEEVLELAGQGLSAEEIAVAAHLAPGTTRNYLSQAMTKVGAQNRFEAFTRARELGWL

SEQ ID NO: 301 - DNA, 753 bp, Corynebacterium glutamicum
  CDS (101)..(730): RXA01607
gggctgaagggctgggcggaacaataattattgaatctacaatcggatcgggaactggaatttccgcccgttttccctatccacaaaaggaccaagataagtgatccgtattctgttggctgatgatcatcccgttgttcgcgcaggccttgcctccttgctggtgagtgaagatgattttgagatagtggacatggtgggcaccccagatgatgccgttgcgcgcgccgcggaaggcggggtggatgtggtgttgatggatctgcgttttggtgatcaaccaggcatcgaggtcgccggcggggtagaggcaacgcgtcgcatccgtgcgctggacaacccgccacaggtactggtggtgaccaactactccacagacggcgatgtggtgggcgcagtatctgctggtgccgtggggtatttgctcaaagatagctccccagaagatctcattgccggtgttcgcgatgccgcgcggggagaatcagtgctttcaaagcaggtcgccagcaagatcatggggcggatgaacaaccccatgactgctctcagtgccagagaaattgaagtgctgtccttggtggcgcaagggcaaagcaatagagaaatcggcaagaaacttttcctcactgaggccacggtgaaaagtcacatggggcatgtgttcaacaagctggatgtcacctctagaacagctgcggtagctgaagccagacagcgcggaattatctagacgcacacgtgttggtaacc

SEQ ID NO: 302 - protein, 210 aa, Corynebacterium glutamicum
VIRILLADDHPVVRAGLASLLVSEDDFEIVDMVGTPDDAVARAAEGGVDVVLMDLRFGDQPGIEVAGGVEATRRIRALDNPPQVLVVTNYSTDGDVVGAVSAGAVGYLLKDSSPEDLIAGVRDAARGESVLSKQVASKIMGRMNNPMTALSAREIEVLSLVAQGQSNREIGKKLFLTEATVKSHMGHVFNKLDVTSRTAAVAEARQRGII

SEQ ID NO: 303 - DNA, 1392 bp, Corynebacterium glutamicum
  CDS (101)..(1369): RXN00470
tcataaccaggttgggcaaaagggatgaatccctggttgtggtggggctcctgaaaagtactcatagactctattgtggagtgttgaggctgataagtgaatgggggaaagccctgaaaaggtggcgttcagggtcttccctgatggtttggtgtcgcaggggcatgacatgatcgaagatatgagtaacacacctgcgccttataccccgcagcctgcggggcaagcggtgcctttatatcccacgtttacccggtcaagagatggtcgggttgttgcgggtgtcgcatcggggctggcaaagcatcttaatgtgtcggtgttttgggttcgtgcgctgctgatttttgcggcgttgctgagcggtgcgggtctttttgcgtatgccttgatttggatttttacgcgcattgagaaaaaggggagtggggaggcgtcgacaagcaagcgctgggtgtcgtggtgcctggtgctgctcgctatcggtggtgctgcggcgtcggtgatgctgagcaccggcttcgcggtgggcacgttggtgcccatcggcgtggtcggtgtgggcctgttgatggtgtggctggcgtatgaccgcggggtggaatccggcccgaatctgctgattattgccaccggcggtgtgttgatgctggtggcgatcgtgctgatcgtgatgaattggaacacccaggacggcttcgtcatggcgctggtggccgtggtgctcacgctggtgggtgtggctgcgctgggcgttccgctgtgggtgcggatgtgggatcagctgggcgaggagcgcgcggaaaaagccgcagctgctgagcgcgcagatattgcttcccgcctgcatgattcggtactgcagaccttggcgctgattcaaaagcgtgccgacgaccccgccgaagtcgcccgcctggcccgcgggcaggaacgcgagctgcgtcaatggctgtttgattcccaagataaaacacctcaaacaaccggcactgtctttactgcgttggagcgcgcctgcggtgaagtcgaggatatttacgctctgcgtatcgtgcctgtgaccgtgggaaccgatgaagcgctgactgagaaaacgcaggcagcggtgatggcagtccgcgaagcactcgtgaacgtggccaagcatgccggcgtggaaaccgccgatgtgtacgccgaaattatgctcggcgaactgaacattttcgtccgcgaccgcggtgcaggattcgaccccgacaacatccccgacgggcaccacgggctcgccgaatccgtccaaggccgcgtcgaacgagccggcggaaaagtacgcatcaaatctgaaatcggcgaaggcaccgaagtggcaatcaccatggatgtgtagttggtcgtacgcgcgtgtct

SEQ ID NO: 304 - protein, 423 aa, Corynebacterium glutamicum
MGESPEKVAFRVFPDGLVSQGHDMIEDMSNTPAPYTPQPAGQAVPLYPTFTRSRDGRVVAGVASGLAKHLNVSVFWVRALLIFAALLSGAGLFAYALIWIFTRIEKKGSGEASTSKRWVSWCLVLLAIGGAAASVMLSTGFAVGTLVPIGVVGVGLLMVWLAYDRGVESGPNLLIIATGGVLMLVAIVLIVMNWNTQDGFVMALVAVVLTLVGVAALGVPLWVRMWDQLGEERAEKAAAAERADIASRLHDSVLQTLALIQKRADDPAEVARLARGQERELRQWLFDSQDKTPQTTGTVFTALERACGEVEDIYALRIVPVTVGTDEALTEKTQAAVMAVREALVNVAKHAGVETADVYAEIMLGELNIFVRDRGAGFDPDNIPDGHHGLAESVQGRVERAGGKVRIKSEIGEGTEVAITMDV

SEQ ID NO: 305 - DNA, 1323 bp, Corynebacterium glutamicum
  CDS (101)..(1300): FRXA00470
tctattgtggagtgttgaggctgataagtgaatgggggaaagccctgaaaaggtggcgttcagggtcttccctgatggtttggtgtcgcaggggcatgacatgatcgaagatatgagtaacacacctgcgccttataccccgcagcctgcggggcaagcggtgcctttatatcccacgtttacccggtcaagagatggtcgggttgttgcgggtgtcgcatcggggctggcaaagcatcttaatgtgtcggtgttttgggttcgtgcgctgctgatttttgcggcgttgctgagcggtgcgggtctttttgcgtatgccttgatttggatttttacgcgcattgagaaaaaggggagtggggaggcgtcgacaagcaagcgctgggtgtcgtggtgcctggtgctgctcgctatcggtggtgctgcggcgtcggtgatgctgagcaccggcttcgcggtgggcacgttggtgcccatcggcgtggtcggtgtgggcctgttgatggtgtggctggcgtatgaccgcggggtggaatccggcccgaatctgctgattattgccaccggcggtgtgttgatgctggtggcgatcgtgctgatcgtgatgaattggaacacccaggacggcttcgtcatggcgctggtggccgtggtgctcacgctggtgggtgtggctgcgctgggcgttccgctgtgggtgcggatgtgggatcagctgggcgaggagcgcgcggaaaaagccgcagctgctgagcgcgcagatattgcttcccgcctgcatgattcggtactgcagaccttggcgctgattcaaaagcgtgccgacgaccccgccgaagtcgcccgcctggcccgcgggcaggaacgcgagctgcgtcaatggctgtttgattcccaagataaaacacctcaaacaaccggcactgtctttactgcgttggagcgcgcctgcggtgaagtcgaggatatttacgctctgcgtatcgtgcctgtgaccgtgggaaccgatgaagcgctgactgagaaaacgcaggcagcggtgatggcagtccgcgaagcactcgtgaacgtggccaagcatgccggcgtggaaaccgccgatgtgtacgccgaaattatgctcggcgaactgaacattttcgtccgcgaccgcggtgcaggattcgaccccgacaacatccccgacgggcaccacgggctcgccgaatccgtccaaggccgcgtcgaacgagccggcggaaaagtacgcatcaaatctgaaatcggcgaaggcaccgaagtggcaatcaccatggatgtgtagttggtcgtacgcgcgtgtct

SEQ ID NO: 306 - protein, 400 aa, Corynebacterium glutamicum
MIEDMSNTPAPYTPQPAGQAVPLYPTFTRSRDGRVVAGVASGLAKHLNVSVFWVRALLIFAALLSGAGLFAYALIWIFTRIEKKGSGEASTSKRWVSWCLVLLAIGGAAASVMLSTGFAVGTLVPIGVVGVGLLMVWLAYDRGVESGPNLLIIATGGVLMLVAIVLIVMNWNTQDGFVMALVAVVLTLVGVAALGVPLWVRMWDQLGEERAEKAAAAERADIASRLHDSVLQTLALIQKRADDPAEVARLARGQERELRQWLFDSQDKTPQTTGTVFTALERACGEVEDIYALRIVPVTVGTDEALTEKTQAAVMAVREALVNVAKHAGVETADVYAEIMLGELNIFVRDRGAGFDPDNIPDGHHGLAESVQGRVERAGGKVRIKSEIGEGTEVAITMDV

SEQ ID NO: 307 - DNA, 1119 bp, Corynebacterium glutamicum
  CDS (101)..(1096): RXA00756
attcgctaaacctgcgcaggatgagactgccctcgcagaaagcacattcgacgaagccaccgcgtaaacagtacgtggtggaagcttgagaggaagacaagtgaatattgatgtccaggctttaaaagccatcgagtctgaaaaaggaatcccagttccagacttgctgcgcaccatcgcctctgcacttttgcattcgtacatggataatcgcgaaactgttgcgtctgcgaacctgaaaccacgcgtggacatcgattccacaactggcacggtcaacgtcatcgtctcagaattcgacgaaaacggagagctcgcttccgaatacgacgacaccccatccaacttcggacgagtcagcgcccgcgctgttcgcgacgcgatcgttaagtccctgcgcgaagcagaagcaagccgagcattcgatgcgtacgcagattatgaaggcaccgttgtgtccggcatcgttcaagcagatgcccgcgcagctgaacgcggaatcatcatcgtgcagctgggtaccgaagcggacaaccaagacggcgttttgctcccagccgagcagatccctggcgaaaagctcaagcacggcgaccgcgtcaagtgcttcgtcgttggcgtgggcaagggcaacactgacatccagatcaacctgtctcgtactcaccctgagctggtgcgccgactgtttgaactggaaatcccagaagttgctgacggatccgtggaaattgttgctatctcccgcgaagccggacaccgctccaaggttgctgttcaagccaaggtgaagaacctcaacgccaagggcgcttgcattggcccacgtggacagcgtgtgtccaacatcatgcgtgaactcggtggagaaaaaatcgacatcatcgattactccgaagatccagcaaccttcgttggaaatgcactggcaccatccaaggttgtcaacgtagaggtcaccgatcttgaagctcaaaccgcgcgcgtaactgtccctgactaccagctttcactagcaatcggtaaagaaggtcaaaacgcccgcttggctgcccgcctgaccggctggaagatcgacatccactctgacatcgattaaaagtcgcttgaaccggcatg

SEQ ID NO: 308 - protein, 332 aa, Corynebacterium glutamicum
VNIDVQALKAIESEKGIPVPDLLRTIASALLHSYMDNRETVASANLKPRVDIDSTTGTVNVIVSEFDENGELASEYDDTPSNFGRVSARAVRDAIVKSLREAEASRAFDAYADYEGTVVSGIVQADARAAERGIIIVQLGTEADNQDGVLLPAEQIPGEKLKHGDRVKCFVVGVGKGNTDIQINLSRTHPELVRRLFELEIPEVADGSVEIVAISREAGHRSKVAVQAKVKNLNAKGACIGPRGQRVSNIMRELGGEKIDIIDYSEDPATFVGNALAPSKVVNVEVTDLEAQTARVTVPDYQLSLAIGKEGQNARLAARLTGWKIDIHSDID

SEQ ID NO: 309 - DNA, 834 bp, Corynebacterium glutamicum
  CDS (101)..(811): RXA00139
gaccggaaacgtactcaaggtagacacccgcgacggttcctacctctcccgcgttaacaactaagattcttaaaacctttaagaatcagccagaaacattttgattgaacaggaacaaagagaacaaaacgtgagcgagcgtcgacaagattacaagcgacacggatcccgctacaaggcgcgcatgcgtgccgtagacatcctatttgaagcggaatcccgcgatgttgatcccgtggccatcatcgatgaccgccacaagttggcgcgcgataccaaccccatcgttgcaccggtagcggaatacaccgaaaccatcatcaatggcgttgccgttgaactcgataccctcgatgtcttcctcgcggaacacatcgcagaaacctggactctcggacgactcccatccgtcgaccgcgcaatcctgcgcgtcgcttcctgggaaatgatctacaacgccgacgttcctgtcaccaccgcaatcgttgaagccgtggaaattgcctccgaatactccggagacaaatccagtgcctacatcaacgcgacacttgacgccatggcatcaaaggtggagaccctccgcgagcgcgccgccaacccagaagcagttctggcggaagcttccgaatctctcgatgatgctccggtcgcgccgtgggatgactcggatgctttggatgactcggatgaagattttgaggctgtagatgctgctgaggtttttgaggctgaagagactgtagaggtttccgaagtcgcagaagactctgaagtttcaaaggtttcagaagaaaaggctgacgagagctaaatcttttctggctaacacca

SEQ ID NO: 310 - protein, 237 aa, Corynebacterium glutamicum
LIEQEQREQNVSERRQDYKRHGSRYKARMRAVDILFEAESRDVDPVAIIDDRHKLARDTNPIVAPVAEYTETIINGVAVELDTLDVFLAEHIAETWTLGRLPSVDRAILRVASWEMIYNADVPVTTAIVEAVEIASEYSGDKSSAYINATLDAMASKVETLRERAANPEAVLAEASESLDDAPVAPWDDSDALDDSDEDFEAVDAAEVFEAEETVEVSEVAEDSEVSKVSEEKADES

SEQ ID NO: 311 - DNA, 1458 bp, Corynebacterium glutamicum
  CDS (101)..(1435): RXA01303
aacatgcgggcgcaggtcagagctgttatcttagtacttatcacagccatagggcgggcttgacggaaagcctttccgcgtaaccatgaagaggcatcacgtgacacaactcaacaccaaaggcgttgttctgcaagggtgggatccagaagatcctgaacattgggactcgaaaattgcatggcgaaccctgtggattaccaccttctccatgattattgggttctgcgtgtggtatttggtttctgccatcgctcccctactcaatcgaattggatttgatctctcagcaggtcagctttattggctcgcatctatccccggtttggccggcggattaatccgattgatttacatgttccttccaccgattcttggaacccgcaaattggtcggaatttcctccggtctatttttgatccccatgtttgggtggttcctggctgtccaagattcaagcactccctactggtggcttctcacactcgctgcactcactggcattggtggtggcgtgttctctggatatatgccgtccacgggatacttcttccccaaggcaaaatcgggcactgcgctgggcattcaggcaggtatcggcaacctcggcgtctcgataattcagttcatgggcccatgggtcatgggtttcggtctgctgggcattggtttcctcaccccgcagcgcaccattgaaggcaccacggtgtttgtgcacaatgctgcgattgtgttggtcccgtggactattctcgcggccgttttatccttcctgtttcttaaagatgtcccagtcaccgcaaatttccggcaacagatcgatatctttggcaacaagaacacatggattttgtccattatctacttgatgacattcggtgccttcgccggtttcgccgcgcagttcggtctgatcatcaacaacaacttcggcatcgcttccccgatggcagagacttatccagctgagatgcttcacgccggtgctacgttcgcgtttcttggacctttgattggtgctttggtgcgtgctgcatggggtccactgtgtgacagattcggtggagctatctggacctttgtcggtggcatcggaatgactatcgccactgcagctgccgcaatcttcctaagcagagcggagacacctgatgatttctggccattcctgtggtccatgcttgccctgttcttcttcaccggtctgggcaatgctggcaccttcaaacaaatgcccatgattttgcctaaacgccaagcaggtggcgtgatcggctggaccggtgccattggtgccttcggccccttcattgtcggtgtcttgctctccttcactccaactgtcgcgttcttctggggctgcgtggtgttcttcatcatcgccaccgctttgacctggatctactacgcccgcccgaacgctccattcccgggataaaccgaaaggccaatccatga

SEQ ID NO: 312 - protein, 445 aa, Corynebacterium glutamicum
VTQLNTKGVVLQGWDPEDPEHWDSKIAWRTLWITTFSMIIGFCVWYLVSAIAPLLNRIGFDLSAGQLYWLASIPGLAGGLIRLIYMFLPPILGTRKLVGISSGLFLIPMFGWFLAVQDSSTPYWWLLTLAALTGIGGGVFSGYMPSTGYFFPKAKSGTALGIQAGIGNLGVSIIQFMGPWVMGFGLLGIGFLTPQRTIEGTTVFVHNAAIVLVPWTILAAVLSFLFLKDVPVTANFRQQIDIFGNKNTWILSIIYLMTFGAFAGFAAQFGLIINNNFGIASPMAETYPAEMLHAGATFAFLGPLIGALVRAAWGPLCDRFGGAIWTFVGGIGMTIATAAAAIFLSRAETPDDFWPFLWSMLALFFFTGLGNAGTFKQMPMILPKRQAGGVIGWTGAIGAFGPFIVGVLLSFTPTVAFFWGCVVFFIIATALTWIYYARPNAPFPG

SEQ ID NO: 313 - DNA, 327 bp, Corynebacterium glutamicum
  CDS (101)..(304): RXA01412
cgccttctttgcagctgagaattaactcacccttgcccttataccccataggggtatagccttgagggagagagtacttcacctgaaaggggccagtgacatggcattaaagaactacaccgttgagggcatgacctgcgcacactgcgtggcatcggtaactgaagaggtaagcgaagttaatggcgttagcgctgttgacgtcactctagaatcaggaaacgtcgctgtcagtggcgaaggtttcagcgatgcagagatccaggctgctgtagaggaagccggctacaagatcgttgcctcctaaagcacccaagaacatttaaa

SEQ ID NO: 314 - protein, 68 aa, Corynebacterium glutamicum
MALKNYTVEGMTCAHCVASVTEEVSEVNGVSAVDVTLESGNVAVSGEGFSDAEIQAAVEEAGYKIVAS

SEQ ID NO: 315 - DNA, 1266 bp, Corynebacterium glutamicum
  CDS (101)..(1243): RXA00773
gcccccaaaaagtgaaagcacaccactttcctagttgcgccctgctcacaatttgcttcaaatattttgcccaacctgattcacgggggacaatagttaggtgactttaaaaatcggcccctttgaccttgcctcccctgtggttctagcccccatggctggtgtaaccaacgttgctttccgcacgctgtgccgtgaacaggaaatgcaacgcacgggaacaatctcggggctgtacgtctgtgaaatggtgactgcgcgtgctcttgttgagcgcaatgagaaaaccatgcacatgaccaccttcgcgccggatgaaaatccccgaagcttgcagctgtacacggttgacccgaagtacacctacgaagcggcgaagatgatcgttgatgaaaacttggcggatcatattgatatgaactttggctgcccggttccaaaggtcacgcgccggggtggcggttctgcgattccttacaagcgccgtttgtttgaaaacatcgtttccgcggctgtgaaggctacggaaggcacggacattccggtgacggtgaagttccgcgttggtattgatgatgagcaccatactcacttggatgctggacgcattgctgtcgacgccggcgcgaagtccgtagcgcttcacgcccgcactgcggcgcagcgctattccggtgaggctgattggaacgagatcgcgcgcctgaaggagcatttggcagataccggcatcccagttttgggcaatggcgatattttcgcggcatccgatgcaacgcgcatgatggagcaaactggctgcgatggcgtcgtggttgggcgtggttgcctgggcaggccttggctctttgctgagctgtctgctgctgttcgtggagaagaaatcccagaggagcctaccttcggcgaagttacccaaatcatcctgcgccacgcagaactcctcatgcagcatgatggcgaaaccaaggggctgcgcgatctgcgtaagcacatgggttggtacctgcgcggtttccctgttggcggcgaattccgctccaatctggccaaggtttccacctatgtggagcttgaggatctcctagcaccatgggctgactccaccgccaaggcagaggacgcggaaggtgcacgaggtcgacagggcgctcctgcaaaggtggcacttccagatggctggttggacgatcctgaggatgccactgttcctaaaggcgcagaaatggaaaactccggagggtagttaatttaatacttaccccc

SEQ ID NO: 316 - protein, 381 aa, Corynebacterium glutamicum
VTLKIGPFDLASPVVLAPMAGVTNVAFRTLCREQEMQRTGTISGLYVCEMVTARALVERNEKTMHMTTFAPDENPRSLQLYTVDPKYTYEAAKMIVDENLADHIDMNFGCPVPKVTRRGGGSAIPYKRRLFENIVSAAVKATEGTDIPVTVKFRVGIDDEHHTHLDAGRIAVDAGAKSVALHARTAAQRYSGEADWNEIARLKEHLADTGIPVLGNGDIFAASDATRMMEQTGCDGVVVGRGCLGRPWLFAELSAAVRGEEIPEEPTFGEVTQIILRHAELLMQHDGETKGLRDLRKHMGWYLRGFPVGGEFRSNLAKVSTYVELEDLLAPWADSTAKAEDAEGARGRQGAPAKVALPDGWLDDPEDATVPKGAEMENSGG

SEQ ID NO: 317 - DNA, 290 bp, Corynebacterium glutamicum
  CDS (1)..(267): RXA02746
ggtgtgcagggcatgactgtcaccgaaacccaaggctttggccagcagaaaggccacaccgaggtgtaccgtggtgctgaatacgctgtcgattttgtgcctaaggtcaagattgaagttattatctccgatgctcaggctgaggaagtcatcaacattatcgtcgagaccgcacgcaccggcaaagtcggcgacggcaaagtgtggatgactaacatcgaagagctggttcgtgttcgtaccggtgagcgcggcgaagcagccctttaaaaacttatgaataatccagc

SEQ ID NO: 318 - protein, 89 aa, Corynebacterium glutamicum
GVQGMTVTETQGFGQQKGHTEVYRGAEYAVDFVPKVKIEVIISDAQAEEVINIIVETARTGKVGDGKVWMTNIEELVRVRTGERGEAAL

SEQ ID NO: 319 - DNA, 902 bp, Corynebacterium glutamicum
  CDS (1)..(879): RXA02745
gccggaatctccttcgaagtcccccgcggtcaagttttggccctcctgggacctaatggcgcaggcaaaaccaccaccattgaaatgtgcgaaggttttaccgcccccacctctggcagcatccgagtcttgggcatcgatccagccacagaaccagaccaggtgcgccgacgcatcggcatcatgcttcaaggtggcggttcctacagcggaatccgcgtgtttgaaatgctcaagcttgcggcgtcctacaacgacaacccacacgatcctgaatggctgcttgatcttgtaggactgcgtgaacaacgcaaaaccacctaccgacgtctgtcaggtggccaacagcaacgcctttctttggccttagcattaattggtcgccctgagattatcttcctcgacgaacccaccgctggcatggatgcgcaatcacgcaacatggtgtgggagcttgtcaacgatctccgccgcgacggcgtcaccatcgtgctcaccacccacctgatggatgaggccgaagcactagctgaccacgtgatcatcgttgccaacggtcaaatccttgccagtggcacacctgatgaactcactgcgcaacgcgatcatcttgaaattaatgtctccgtagagaccacgagcccgcttgatcttgatcgcttggtggatgatctcagcagcttaaacatcggtgatgtgaaagcacgagccaaccggccactgcattattcacttcggacgcaacaagccaccccggattccttggcgcacatcgtccaggctgtcgcccgccaaaacgtcatgattcgctctttggatacgggacaccgctcattggaagatgtcttcctggacatcaccggaaaagaactgaggagttaacgcacaccatgtctaaacct

SEQ ID NO: 320 - protein, 293 aa, Corynebacterium glutamicum
AGISFEVPRGQVLALLGPNGAGKTTTIEMCEGFTAPTSGSIRVLGIDPATEPDQVRRRIGIMLQGGGSYSGIRVFEMLKLAASYNDNPHDPEWLLDLVGLREQRKTTYRRLSGGQQQRLSLALALIGRPEIIFLDEPTAGMDAQSRNMVWELVNDLRRDGVTIVLTTHLMDEAEALADHVIIVANGQILASGTPDELTAQRDHLEINVSVETTSPLDLDRLVDDLSSLNIGDVKARANRPLHYSLRTQQATPDSLAHIVQAVARQNVMIRSLDTGHRSLEDVFLDITGKELRS

SEQ ID NO: 321 - DNA, 486 bp, Corynebacterium glutamicum
  CDS (101)..(463): RXN00820
acttccaccaccccaaaccatcgtttctttcgaagacgcaccaaccctcaccggccaggacctgggcttttcgcagtggcgcactgtcacccaggagatggtgaacaccttggcggacgcaactgatgatcagcagtggattcacactgatcctgagcgcgccaaggacggtccttttggtggcgcaattgcccacggtttcctcaccttgtccatgatcattccgttctggggcgagcttctcgatgtcaccggcgtgaccaccaaggtgaactatggcctggataaggtgcgtttcacctctcccgtcaaggtcggttcccgcatccgcatgggcgctgtggtccgtgagatctctgaggtgaagggcaatggcctgcacctggtcgccgatggcactattgagatcgaagggcaggagcgcccggccgtcgtagctaccttcctcacccgcttctacgcttaaaagcttgcttctcgacgcaa

SEQ ID NO: 322 - protein, 121 aa, Corynebacterium glutamicum
VNTLADATDDQQWIHTDPERAKDGPFGGAIAHGFLTLSMIIPFWGELLDVTGVTTKVNYGLDKVRFTSPVKVGSRIRMGAVVREISEVKGNGLHLVADGTIEIEGQERPAVVATFLTRFYA

SEQ ID NO: 323 - DNA, 486 bp, Corynebacterium glutamicum
  CDS (101)..(463): FRXA00820
acttccaccaccccaaaccatcgtttctttcgaagacgcaccaaccctcaccggccaggacctgggcttttcgcagtggcgcactgtcacccaggagatggtgaacaccttcgcggacgcaactgatgatcagcagtggattcacactgatcctgagcgcgccaaggacggtccttttggtggcgcaattgcccacggtttcctcaccttgtccatgatcattccgttctggggcgagcttctcgatgtcaccggcgtgaccaccaaggtgaactatggcctggataaggtgcgtttcacctctcccgtcaaggtcggttcccgcatccgcatgggcgctgtggtccgtgagatctctgaggtgaagggcaatggcctgcacctggtcgccgatggcactattgagatcgaagggcaggagcgcccggccgtcgtagctaccttcctcacccgcttctacgcttaaaagcttgcttctcgacgcaa

SEQ ID NO: 324 - protein, 121 aa, Corynebacterium glutamicum
VNTFADATDDQQWIHTDPERAKDGPFGGAIAHGFLTLSMIIPFWGELLDVTGVTTKVNYGLDKVRFTSPVKVGSRIRMGAVVREISEVKGNGLHLVADGTIEIEGQERPAVVATFLTRFYA

SEQ ID NO: 325 - DNA, 732 bp, Corynebacterium glutamicum
  CDS (101)..(709): RXA01059
aattattagctttccaatacaaaatttaaatcccagagcgatctgccccacacttacttgatgcgggaacaaatttgaaggtttttcagttgctataggtatgactacagttactcaagaccttctagcacttgacgaagacgcacagaacctccttttccgtgaggctcgcaccgcaaatgctttcactgatgaaccaatctctgacgagcagatcgaagcaatcttcgacctagttaagtgggcaccaaccgcaatgaactcccagcctctgcgcgtggtaattgttcgttccgaagaagccaaagctcgcctcgtgccattgatggcagaaggcaaccaggccaaggttgctgcagctcctgcggtcgcacttcttgcagccgacatcgacttccacgaagaaatgcccaagctcttcccacctttcccaggcgcacgcgacatgttcgaagccgatgaagcttcacgtgcttcctccgcagaactcaatgctggccttcagatcggatacgccatcatcggtatccgcgcagcaggtctcgccgctggcccaatgaccggcatggatgcagacgctatctccaaggagttcttcccagacggccgccaccgcgttctggttgccatcaacatgggtaagccagctgacaatgcttggtacgaccgcctgccacgccttgagcaggacgaagttgtcgaaaccctctagaaaccactctagaaatagct

SEQ ID NO: 326 - protein, 203 aa, Corynebacterium glutamicum
MTTVTQDLLALDEDAQNLLFREARTANAFTDEPISDEQIEAIFDLVKWAPTAMNSQPLRVVIVRSEEAKARLVPLMAEGNQAKVAAAPAVALLAADIDFHEEMPKLFPPFPGARDMFEADEASRASSAELNAGLQIGYAIIGIRAAGLAAGPMTGMDADAISKEFFPDGRHRVLVAINMGKPADNAWYDRLPRLEQDEVVETL

SEQ ID NO: 327 - DNA, 1053 bp, Corynebacterium glutamicum
  CDS (101)..(1030): RXN01386
ctctattgtggtacgcaccatgactgctcaaccagcccacgagccgccaaggcatctccggttcagtacgagcgggatcctcccggacaatcgcgtccaaatgtgggagggccacaatgctcgcgcattgcttccgctcgacattagaaccattgacgatcgccccatgcaggcctccgaaaccaacctgcacctcccatcaatgcggatggcgagcgtattcgggacttcgcaatttgtcgagcgttcagagagtttcatctcagaaaaccccacgggtgtggttgcgatcttctttgcgactgaaggtgaagcagtcttcttccaccgtggtggacatgtagcgcttcggccaggtcaggccattgtttacgacgccgataggccattcctccgcggattcaacaatcgcttccgcgagctagttctcaccatcccgaagcagcgctaccttgaaattgttggctcaaaaggccctgagcttcccgctatttttgagttcggagcaacaggaaccgccaatgaacaagctttagcgcgactagttcaggaatctctacacaggattgaaagtggcgagccgaagcatatcgattccagtggacctttaggaaaaccgtggagcgatatcgagcacgaggcccacggacttatccgcaatgtacttggcgacgccacaagtagcgaagaaggcttaatttctgcagcccagagatttattgacatcaatatttccgaaagtgacttacaagcgtcgcggattgctgcagccgtgggaatcagcgaacgccaactaagtcgaatcttctcagactcaggacaaactatcggacgctacgtcctaaacacccgactggattttgcaaaggaagcgctgtcgacaccggagcgagacaaggtttcggtcagtgagatcggtaagcgctttgggttcgcttccccaagtcatttcagtcgcaccttccgcgagcggtttgaaatgacgccgcttcaatggaggaaggaatcgcagcgtcaatcctttcaagagtgaggtttttgttctcaggcgga

SEQ ID NO: 328 - protein, 310 aa, Corynebacterium glutamicum
MWEGHNARALLPLDIRTIDDRPMQASETNLHLPSMRMASVFGTSQFVERSESFISENPTGVVAIFFATEGEAVFFHRGGHVALRPGQAIVYDADRPFLRGFNNRFRELVLTIPKQRYLEIVGSKGPELPAIFEFGATGTANEQALARLVQESLHRIESGEPKHIDSSGPLGKPWSDIEHEAHGLIRNVLGDATSSEEGLISAAQRFIDINISESDLQASRIAAAVGISERQLSRIFSDSGQTIGRYVLNTRLDFAKEALSTPERDKVSVSEIGKRFGFASPSHFSRTFRERFEMTPLQWRKESQRQSFQE

SEQ ID NO: 329 - DNA, 1806 bp, Corynebacterium glutamicum
  CDS (101)..(1783): RXN00073
gaatctaatggttggtctagacagagcggtacgtctaagtttgcggatagatcaaaccgagtgacatgtacttcactagctctttaaggattaactccccatgacaacaaccaccggaagtgcccggccagcacgtgccgccaggaagcctaagcccgaaggccaatggaaaatcgacggcaccgagccgcttaaccatgccgaggaaattaagcaagaagaacccgcttttgctgtcaagcagcgggtcattgatatttactccaagcagggtttttcttccattgcaccggatgacattgccccacgctttaagtggttgggcatttacacccagcgtaagcaggatctgggcggtgaactgaccggtcagcttcctgatgatgagctgcaggatgagtacttcatgatgcgtgtgcgttttgatggcggactggcttcccctgagcgcctgcgtgccgtgggtgaaatttctagggattatgctcgttccaccgcggacttcaccgaccgccagaacattcagctgcactggattcgtattgaagatgtgcctgcgatctgggagaagctagaaaccgtcggactgtccaccatgcttggttgcggtgacgttccacgtgttatcttgggctccccagtttctggcgtagctgctgaagagctgatcgatgccaccccggctatcgatgcgattcgtgagcgctacctagacaaggaagagttccacaaccttcctcgtaagtttaagactgctatcactggcaaccagcgccaggatgttacccacgaaatccaggacgtttccttcgttccttcgattcacccagaattcggcccaggatttgagtgctttgtgggcggtggcctgtccaccaacccaatgcttgctcagccacttggttcttggattccacttgatgaggttccagaagtgtgggctggcgtcgccggaattttccgcgactacggcttccgacgcctgcgtaaccgtgctcgcctcaagttcttggtggcacagtggggtattgagaagttccgtgaagttcttgagaccgaatacctcgagcgcaagctgatcgatggcccagttgttaccaccaaccctggctaccgtgaccacattggcattcacccacaaaaggacggcaagttctacctcggtgtgaagccaaccgttggacacaccaccggtgagcagctcattgccattgctgatgttgcagaaaagcacggcatcaccaggattcgtaccacggcggaaaaggaactgctcttcctcgatattgagagaaagaaccttactaccgttgcacgcgacctggatgaaatcggactgtactcttcaccttccgagttccgccgcggcatcatttcctgcaccggcttggagttctgcaagcttgcgcacgcaaccaccaagtcacgagcaattgagcttgtcgacgaactggaagagcgcctcggcgatttggatgttcccatcaagattgcactgaacggttgccctaactcttgtgcacgcacccaggtttccgacatcggattcaagggacagaccgtcactgatgctgacggcaaccgcgttgaaggtttccaggttcacctgggcggttccatgaacttggatccaaacttcggacgcaagctcaagggccacaaggttattgccgatgaagtgggagagtacgtcactcgcgttgttacccacttcaaggaacagcgccacgaggacgagcacttccgcgattgggtccagcgggccgctgaggaagatttggtgtgagtcttcggaggaaacccaat

SEQ ID NO: 330 - protein, 561 aa, Corynebacterium glutamicum
MTTTTGSARPARAARKPKPEGQWKIDGTEPLNHAEEIKQEEPAFAVKQRVIDIYSKQGFSSIAPDDIAPRFKWLGIYTQRKQDLGGELTGQLPDDELQDEYFMMRVRFDGGLASPERLRAVGEISRDYARSTADFTDRQNIQLHWIRIEDVPAIWEKLETVGLSTMLGCGDVPRVILGSPVSGVAAEELIDATPAIDAIRERYLDKEEFHNLPRKFKTAITGNQRQDVTHEIQDVSFVPSIHPEFGPGFECFVGGGLSTNPMLAQPLGSWIPLDEVPEVWAGVAGIFRDYGFRRLRNRARLKFLVAQWGIEKFREVLETEYLERKLIDGPVVTTNPGYRDHIGIHPQKDGKFYLGVKPTVGHTTGEQLIAIADVAEKHGITRIRTTAEKELLFLDIERKNLTTVARDLDEIGLYSSPSEFRRGIISCTGLEFCKLAHATTKSRAIELVDELEERLGDLDVPIKIALNGCPNSCARTQVSDIGFKGQTVTDADGNRVEGFQVHLGGSMNLDPNFGRKLKGHKVIADEVGEYVTRVVTHFKEQRHEDEHFRDWVQRAAEEDLV

SEQ ID NO: 331 - DNA, 373 bp, Corynebacterium glutamicum
  CDS (101)..(373): RXN03131
aacgcggctcgtgaagattacctgaaaaaccaagccctccagcgtccgctgctcggctaaaccagttggctaaaccaaaacgtatttaaggagaaacaccatgaccacttctgtacctgcatccaccaaagctttatctgtggctggcgaaaacccaggcctgcgcatcggcaccgcacctgactcgtggggcgtgtggttcccagaggatccaaagcagatcccttgggagcgttttctctacgaggtcgtgaaagctggctacacctggatcgagcttggcccatacggctacctgccaaccgatgccaaccagcttgaagatgaactgggcaagcgcggcctgaagctgtccgctggcaccgagttcacc

SEQ ID NO: 332 - protein, 91 aa, Corynebacterium glutamicum
MTTSVPASTKALSVAGENPGLRIGTAPDSWGVWFPEDPKQIPWERFLYEVVKAGYTWIELGPYGYLPTDANQLEDELGKRGLKLSAGTEFT

SEQ ID NO: 333 - DNA, 549 bp, Corynebacterium glutamicum
  CDS (101)..(526): RXS00153
cctcgatttgagtaaagaggacgtcctcgcctgatttttcgggtgtgtttttgcgtggcgagccctgcctggcccttccaaattatgtagggtggcctgcgtgggagcaataatttggtttatcggagcattggttcttgctggcttggaattggcagtaggtgagttcaccttattgatgctcggcggtgcagctttggcaaccgccggcgtggcactcatcggtgtcccagtatgggctgaatttgtcaccttcgcggtggcctcagctgctctactgatgttcattaggccggccattagaaagcgtctgctgaaaccaaaggttctggactcttcaccacgagcacttgttggccaccgtgctgaagtgctcgaagatgtcggagcgaccagcgggcaggtccgcctggatggttcaatttggtccgcccgcagcatggatcccacacacaccttcgcggaaggtgaaattgtcagtgtcattgatatccaaggcacgaccgcgattgtatggaaagaagcctaaatttttaacaatcaaatagt

SEQ ID NO: 334 - protein, 142 aa, Corynebacterium glutamicum
VGAIIWFIGALVLAGLELAVGEFTLLMLGGAALATAGVALIGVPVWAEFVTFAVASAALLMFIRPAIRKRLLKPKVLDSSPRALVGHRAEVLEDVGATSGQVRLDGSIWSARSMDPTHTFAEGEIVSVIDIQGTTAIVWKEA

SEQ ID NO: 335 - DNA, 509 bp, Corynebacterium glutamicum
  CDS (1)..(486): RXN01716
gaagtcactcctgagggattcaaagagatcacccgtgaaaacaccatcgttcgcctgggcaaaggcgtcgacgccaccggtcagctagaccccgaggcaatcgagcgcactcgtgtcgctttggaaaactacgttgaactcatggaaacccatggggtagaggccgtacgaatggttgccacctccgcaacccgcgatgcgtccaaccgcgatgaattcttttcgatgacccgccagcttctgtccaagatccgtcctggataccaagctgaagtaatttccggcgaagaggaagctctgctgtccttccgaggtgcaatcgttgacctgcctgaagaccaaggtcctttctgtgttatcgaccttggcggtggatccactgagttcatcgttggcacctacgacggtgaaatcctaggctcccactcaacccaaatgggatgcgtgcgcctgaccgaacgaatcatgcgcagcgacccacccgactgaaaccgaagtggaaatcgccc

SEQ ID NO: 336 - protein, 162 aa, Corynebacterium glutamicum
EVTPEGFKEITRENTIVRLGKGVDATGQLDPEAIERTRVALENYVELMETHGVEAVRMVATSATRDASNRDEFFSMTRQLLSKIRPGYQAEVISGEEEALLSFRGAIVDLPEDQGPFCVIDLGGGSTEFIVGTYDGEILGSHSTQMGCVRLTERIMRSDPPD

SEQ ID NO: 337 - DNA, 534 bp, Corynebacterium glutamicum
  CDS (101)..(511): RXN02972
acctacgacggtgaaatcctaggctcccactcaacccaaatgggatgcgtgcgcctgaccgaacgaatcatgcgcagcgacccacccgactgaaaccgaagtggaaatcgcccgcgactacgttgcagaacgcatccaggaagtaaaagccatcgtcccaatttcaaaggcaaaaacctttgtgggatgcgcaggcaccttcaccacaatctccgcctgggtgcaaggcctagaaagctacgaccgcgacgcgatccacctctctgcactcaacttcgatgcactgcgagttgtcaccgatgagatcatttcagaatcatcatcacagcgcgccagcaacccagttgttgatccaggtcgcgccgacgtcatcggtggcggatccgttgttgtccaagcagcgatcgacttagcctccaaagaagccggtgtagactacatcattatttccgaaaaagacatcctcgacggcctcatccttggcctggtagaagccgactctttgaagaaataggaccctagttttaaaccact

SEQ ID NO: 338 - protein, 137 aa, Corynebacterium glutamicum
VEIARDYVAERIQEVKAIVPISKAKTFVGCAGTFTTISAWVQGLESYDRDAIHLSALNFDALRVVTDEIISESSSQRASNPVVDPGRADVIGGGSVVVQAAIDLASKEAGVDYIIISEKDILDGLILGLVEADSLKK

SEQ ID NO: 339 - DNA, 1497 bp, Corynebacterium glutamicum
  CDS (101)..(1474): RXN00663
ctgaacgattggtgaccggctcatgaaaacttgacgagtccccggtattcgccagcggtgactactaccgtgggcgacaagcccacttagaggaggacttgtgacaaccacctatccagatttccttggaaattcttcgctccaaacagatacggagcactgggaaatggaaggaggtgcgcaggaagtctctgttacttatgttttggacacgtcagtgttgctgtctgatccgttgtcgttgacacggttcgcggagcacgatgtagttctgccaattgttgtaattacggaattagaagccaagcgtcatcacccggaccttggcttttttgctcgccaagcgcttcggatgctggatgagctgcgtgagatccatggggatttgtccaagccactgccaattggcgatgaaggcggacacatccatgttgagctgaatcaccaaaacacggggtccttgcccgtgggattccgccttggtgacaatgacacccgcatccttgcagtggccaagaatctgcaggaagagggccacaatgtggttctggtgtcgaaggacctgccgatgcggattaaggcgtcggcaagcggaatcgccgcacaggaataccgcgctgccctggcgcgcgaccgtggttacaccggcatgacccacgccaatatcaccgatgaccagctcagcgagctctacgacaccggcgaggtgcgcattgaggagctcgaaaagctgcccgtcaaccacggcttcaccctcaaatccaacagcggttcggcgcttggtcgtatgaattccgacaagatcatcgagcttgtccccggcgaccagcaggtattcggtatcagcgggcgtagcgctgagcagcgggttgccattgatttgcttaacgacgacgccgtcggcatcgtatccatcggcggccccgcgggtacaggtaaaagcgcactcgcactgtgtgccggcctggaagctgtgatggagcgtcgcattcagcgcaagattatcgtgttccgcccactctttgccgttggcggacaggaacttggctacctgcctggcgaccaagaagaaaaaatggggccttgggcgcaagcggtttttgacaccctaagctccatggtcagccaaaacatcatcgatgaagccctctcccgcggcctcatcgaagttctcccacttactcacatccgcggacgctcactccacgatgctttcgtcatcgtcgacgaggcccaatccctagaacgcaacgtgttgctcaccatgctgtctcgcatcggccagaattcccgagtagttctcacccatgacgtagcgcagcgcgacaacctgcgcgttggtcgctacgacggcatcgtctctgtggtggaagcactcaaggatcacgaactgtttggccacatcacgttgcagcgttccgaacgctcccgaatcgctgagttggtcacccaagttttggatgcgccgtctctgtagtcgcgcagtctgtggcgatt

SEQ ID NO: 340 - protein, 458 aa, Corynebacterium glutamicum
VTTTYPDFLGNSSLQTDTEHWEMEGGAQEVSVTYVLDTSVLLSDPLSLTRFAEHDVVLPIVVITELEAKRHHPDLGFFARQALRMLDELREIHGDLSKPLPIGDEGGHIHVELNHQNTGSLPVGFRLGDNDTRILAVAKNLQEEGHNVVLVSKDLPMRIKASASGIAAQEYRAALARDRGYTGMTHANITDDQLSELYDTGEVRIEELEKLPVNHGFTLKSNSGSALGRMNSDKIIELVPGDQQVFGISGRSAEQRVAIDLLNDDAVGIVSIGGPAGTGKSALALCAGLEAVMERRIQRKIIVFRPLFAVGGQELGYLPGDQEEKMGPWAQAVFDTLSSMVSQNIIDEALSRGLIEVLPLTHIRGRSLHDAFVIVDEAQSLERNVLLTMLSRIGQNSRVVLTHDVAQRDNLRVGRYDGIVSVVEALKDHELFGHITLQRSERSRIAELVTQVLDAPSL

SEQ ID NO: 341 - DNA, 1248 bp, Corynebacterium glutamicum
  CDS (101)..(1225): RXN00778
aggtcttaggtttttaagtcgtgagcaatccggagggaaactagcccgcctacaggatctgctcagacgatgtcttcacttaaaccggaaaggcttccccgtgaacctcactcttaagcgctccatcgcccttgtgggcgcagttactgcaggctccttcgctcttgtagcttgctccgactccaatgagtctgattccacctcctcatctgcagcttccaccggttcttccgatgctgcatccattgagggcctttccggtgttaccggtcagctcgttgctgaaggtgcatcttcccagcagtccgcaatggactactttggtatccgttactccgaggctgtcagcggtgcatctctggcttacaccccttcaggttccggttccggccgcaccaacttcgctgcaggccaggttgctttcggtggctccgactccgcaatgaaggacgaccaggctgcagaagcagaagcacgttgcaacggcaacgaagcatggcacctgccattcgttatcggcccagttgcagttgcttacaacctgcctggcgttgacaccctgaacctggacaccaacatcatcgctcagatcttcaagggcgagatcaccaagtggaacgacgaagcaatcgcttcccagaacgagggcaccgacctcccagaccaggacatctccgttctgtaccgttccgaagagtccggtacctccgacaacttccagaagttcctcggagcttccaccgacatctgggagaccgaaggccagcagttcccaaccgaggttggctccggtgcgcagggctccaacggtgtagcttctgaggcttccaacatcgagggtgcaatcacctacgttgaagctggtttcgctaaccagtccggcctgggcgttgcaaacatcgacttcggttccggcccagttgaactcaacgctgagtccgttggcgttgcacttggtgcactcgacttcctgactgagggccacaacatggttgttgacaccgacgctatgttcgcaatgaacgaagccggtgcttacccactgatcctcaccacctacgaaatcgtctgctccgcaggctacgacgagaccacccgcgaccaggtcaaggacttcctgaccgttgcactggactcccaggatgaccagctcgaggctctcggctacatcccagttaccggcgagcactacgatcgcctcgttgcagcagttgaagcaattcagtaataaaccgctgccgtagcttc

SEQ ID NO: 342 - protein, 375 aa, Corynebacterium glutamicum
VNLTLKRSIALVGAVTAGSFALVACSDSNESDSTSSSAASTGSSDAASIEGLSGVTGQLVAEGASSQQSAMDYFGIRYSEAVSGASLAYTPSGSGSGRTNFAAGQVAFGGSDSAMKDDQAAEAEARCNGNEAWHLPFVIGPVAVAYNLPGVDTLNLDTNIIAQIFKGEITKWNDEAIASQNEGTDLPDQDISVLYRSEESGTSDNFQKFLGASTDIWETEGQQFPTEVGSGAQGSNGVASEASNIEGAITYVEAGFANQSGLGVANIDFGSGPVELNAESVGVALGALDFLTEGHNMVVDTDAMFAMNEAGAYPLILTTYEIVCSAGYDETTRDQVKDFLTVALDSQDDQLEALGYIPVTGEHYDRLVAAVEAIQ

SEQ ID NO: 343 - DNA, 870 bp, Corynebacterium glutamicum
  CDS (101)..(847): RXN00250
acaacaccagaccaccccaaccctgaataaacccctatttttctaaaaagtcacactttgccgtatagaaattcagtcaaccaagagtactctgtccaccatggtttttactcttgcggactccgtctcccaggttgcgctaggtccgtcctggctggaccctatggaacttctttccggctccggcccgttcggtagcttcattcttccggcgatgcttgccattgtctttatcgaatcaggcctacttttcccacttctaccaggtgattctctccttttcaccggtggtctcctagctaaccaggctgacccttttgcaccgctgtggctggtgctgatcctctgccctatcgccgcaattcttggcgatcaggtgggttactggattggccacaagttccaccctcgcctggtcaatcgtccggatggcaggattttcaagcaggaatacctcaagcagactgaggatttctttgagaagcatggccccgtgacgatcattttgtgccgtttcgtgcccatcgtccgtacttacgcacctctggtcgcaggtatggctggcatgcgttaccgcacgttcattatttacaacatgatcggtggcattttgtggggttccggcgtggtggctttgggtgctgcgttgggtcagttcgatttcgtccgcaacaatattgatctgattttcttgctgatcgtgttcatttcggtggttcctggtttggtcggcatggcccgcaagctggctgacggccacaagcaagccaacaccgagccacaagaaaaccccgcagtccagacagccccagtaaaaacccaggaagcccaggaagccccccagaactaatctttccggtccgccagttc

SEQ ID NO: 344 - protein, 249 aa, Corynebacterium glutamicum
MVFTLADSVSQVALGPSWLDPMELLSGSGPFGSFILPAMLAIVFIESGLLFPLLPGDSLLFTGGLLANQADPFAPLWLVLILCPIAAILGDQVGYWIGHKFHPRLVNRPDGRIFKQEYLKQTEDFFEKHGPVTIILCRFVPIVRTYAPLVAGMAGMRYRTFIIYNMIGGILWGSGVVALGAALGQFDFVRNNIDLIFLLIVFISVVPGLVGMARKLADGHKQANTEPQENPAVQTAPVKTQEAQEAPQN

SEQ ID NO: 345 - DNA, 541 bp, Corynebacterium glutamicum
  CDS (101)..(541): RXA00072
acggccaggacgatccagtgcacaggccagcaccagcaaagtccacatcgcaagcattaaaagaatctctcgaaagacacaaaagaggtgagtcgcaacaatgagctttcaactagttaacgccctgaaaaatactggttcggtaaaagatcccgagatctcacccgaaggacctcgcacgaccacaccgttgtcaccagaggtagcaaaacataacgaggaactcgtcgaaaagcatgctgctgcgttgtatgacgccagcgcgcaagagatcctggaatggacagccgagcacgcgccgggcgctattgcagtgaccttgagcatggaaaacaccgtgctggcggagctggctgcgcggcacctgccggaagctgatttcctctttttggacaccggttaccacttcaaggagacccttgaagttgcccgtcaggtagatgagcgctattcccagaagcttgtcaccgcgctgccgatcctcaagcgcacggagcaggattccatttatggtctcaacctgtaccgcagcaacccagcg

SEQ ID NO: 346 - protein, 147 aa, Corynebacterium glutamicum
MSFQLVNALKNTGSVKDPEISPEGPRTTTPLSPEVAKHNEELVEKHAAALYDASAQEILEWTAEHAPGAIAVTLSMENTVLAELAARHLPEADFLFLDTGYHFKETLEVARQVDERYSQKLVTALPILKRTEQDSIYGLNLYRSNPA

SEQ ID NO: 347 - DNA, 1299 bp, Corynebacterium glutamicum
  CDS (101)..(1276): RXA00793
tcgctggtttttagatggttttcaagccagcgagaccacattagtttcacgctggttgaaacctttgagatcaatatagaccgtgtggtctactcgaggaatgagtgaaaacaatcccactaccttgcactggttcctacccacctatggcgattctcgcggaatcacagccggcgggcatggcttcggcttccactccggaagccggacagcagacctcgattacctctcccaaattgccctggccgctgaacgaaacggttttgaatccgtcctgactcccactggattgtggtgcgaagatgcgtggatcaccaccgcagcgctgctgtctaggacatcaaaactgaaattcctcgttgctattcgaccaggccaagttagccccaccatcatcgcgcagcagggtgctgccttccagaaattctcaaataaccgcctgctcatcaacgtcgtggtgggtggcgaagaccatgaacagcgcgctttcgctgattattcttccaaagaggagcgctaccacaaggctgatgaaaccttagagatcatcgatcacctatggaacagcgcagaacctctaaatttccagggtgaattcctcagtgtggaaaacgcggtattgaaggaacagcccgaggtttccccaccgatttactttggcggatcctcacaactcggcatcgaaatcgcagcccaacattccgatgtttatctcacctggggtgaacctgcggaaaaggtagaggagaagcttgcccgggtgcgcgccgaagcagataagcgaaaccgcgaactagactatggcatccgcctgcatgtcattgctcgaccaactgaggatgaagcctggtcagtggctcaaaatcttcttgaccaacttgatcaggaagaggttgcccgcattcaggaagggcttgcgcgttctcaatcggaaggtcagcgtcgcatgacggaacttcatggacaaggggcagcattcacagcaggagcagatgctcgctcccttgaaattgcaccgaatctctgggcaggtgttgggctagtccgcggtggcgccggcacagcgttggtgggttcctatgagcaagtcgcgcaagcaattttgcgataccgcgatattggtctgagccacttcattttctccggctatccacatttggaggaaacctatcacgtgggcgaaggagtggtacctgagctcctcaaattgggtgttccggtgaacaaccatgaagaacaacgcaacgacgtggtagcgactccgtttatttccagatagatcacggatcggctgcttta

SEQ ID NO: 348 - protein, 392 aa, Corynebacterium glutamicum
MSENNPTTLHWFLPTYGDSRGITAGGHGFGFHSGSRTADLDYLSQIALAAERNGFESVLTPTGLWCEDAWITTAALLSRTSKLKFLVAIRPGQVSPTIIAQQGAAFQKFSNNRLLINVVVGGEDHEQRAFADYSSKEERYHKADETLEIIDHLWNSAEPLNFQGEFLSVENAVLKEQPEVSPPIYFGGSSQLGIEIAAQHSDVYLTWGEPAEKVEEKLARVRAEADKRNRELDYGIRLHVIARPTEDEAWSVAQNLLDQLDQEEVARIQEGLARSQSEGQRRMTELHGQGAAFTAGADARSLEIAPNLWAGVGLVRGGAGTALVGSYEQVAQAILRYRDIGLSHFIFSGYPHLEETYHVGEGVVPELLKLGVPVNNHEEQRNDVVATPFISR

SEQ ID NO: 349 - DNA, 681 bp, Corynebacterium glutamicum
  CDS (101)..(673): RXA01192
ccacggtgaacacctgcaggtggagcaagctagccttgcgcatccgccagagattattccggagattctttttggtggatcgtcgccagctgcaggtgaggtggctgcacgttatgcggacacctatctcacgtggggtgaaactcccgatcaggtggcgcagaaaatcaactggatcaacgagctagcagcacagcgcggccgggaactgcgccatggaatccgcttccatgtgatcacccgcgatacgtctgaagaagcatgggtggtggcagagaagttgattagcggggtcactccagaacaggtcgctaaggctcaagccgggtttgcaacgtctaagtcggaggggcagcgccggatggctgagctgcacagcaagggtcgtgcctttactagtggctcaactgctcgtgatctggaggtgtatcccaatgtgtgggcaggcgtcggtttgcttcgcggaggtgcaggaacagcccttgtgggctcgcatgaagaggtcgccgatcgcatcgaagaatacgcagcactcggcttggatcagtttgtactgtcgggttatccaaacttggaggaggccttccacttcggtgagggtgtgattccgaaactgctgcgccgcggtgtggatatcaaaaatcaagaatcacgagttttggaacctgttgggtaaacggg

SEQ ID NO: 350 - protein, 191 aa, Corynebacterium glutamicum
VAARYADTYLTWGETPDQVAQKINWINELAAQRGRELRHGIRFHVITRDTSEEAWVVAEKLISGVTPEQVAKAQAGFATSKSEGQRRMAELHSKGRAFTSGSTARDLEVYPNVWAGVGLLRGGAGTALVGSHEEVADRIEEYAALGLDQFVLSGYPNLEEAFHFGEGVIPKLLRRGVDIKNQESRVLEPVG

SEQ ID NO: 351 - DNA, 918 bp, Corynebacterium glutamicum
  CDS (101)..(895): RXA00715
gtggtgttaagcactaagatggcaggttatgacttctcttaaagtaacttcgtccgcagatgcaaccaataacaatgatgcccattttcctgaaggtccagtggtaaccgttgactggttgtcacacaaccttgaccgggatgatgtcatcgtgttgtgtgccacaatggaggatgatgaaattgcacgtcaagcgggaattccgggggcatttctcgctgacttggaaggagatttctcagatccacattccgagcttccacacaccgcgccaccaaatttggtgggtttgctagaaagctacggcattagcaccgattccacggtggttgtttatgatctgcacggcctcatggttgcaccgcgggtgtggtggcttctccgtgttgctggattaagcagcattggcgtgcttgatggcggattgccagcctgggttgatgctggccttccaacggaaccgctgtcgctacctacaagtggtggaaggatcagcgcagaaccacagccagatttactcgttggtgcctccggcgttgaacgggcgatcgcgcgctcaagcaaggcagtgattgatgctcgtaatgcgagccgattcgctggcgttgaagaagagccccgtccaggccttcgaaaagggtcgatccctggaagcgtcaacattcccttcactgacatttctgatgagcatggttttgtccggccagcagaagaactgaaggaattgatcttcagccgcacaaatggagcgcagtcgttggtctttagctgtggctccggagtcacggcatgtgttgatgcctacgctgcagttatcgcaggttatgacgacgttgtagtgtatgaaggctcttgggcggagtggggcaacccggcaaaccaaaagccgattgcttaacgcccgctatgataaccact

SEQ ID NO: 352 - protein, 265 aa, Corynebacterium glutamicum
VVTVDWLSHNLDRDDVIVLCATMEDDEIARQAGIPGAFLADLEGDFSDPHSELPHTAPPNLVGLLESYGISTDSTVVVYDLHGLMVAPRVWWLLRVAGLSSIGVLDGGLPAWVDAGLPTEPLSLPTSGGRISAEPQPDLLVGASGVERAIARSSKAVIDARNASRFAGVEEEPRPGLRKGSIPGSVNIPFTDISDEHGFVRPAEELKELIFSRTNGAQSLVFSCGSGVTACVDAYAAVIAGYDDVVVYEGSWAEWGNPANQKPIA

SEQ ID NO: 353 - DNA, 945 bp, Corynebacterium glutamicum
  CDS (101)..(922): RXA01664
cgggttaccaaagtgaatggtaggggaagtttccgtgtcttataccggttaggttttgcccgcgctgcgcttggtcacattaacgcctaggctcggggctatgaccgtgttgatttctccgtccacccttgctgaatcaatccacgctggtaagaaacaaactgttctcgctgctttctgggctccaattgaaggagcaggccgcacagttttctgctctgagcacatcccaacttccattttctgcgaccctgcccttgagctttccggagttccttcctctgaagatggccgcaacccactgccaccgctgaatgtgttggcacgttctttcaggacctggggtttgaataccgatcgtgaaatcgtgttttacgatcagggacgtggcctttttgctgcacgcgcctggtggatcctccgatgggcgggcatgcccaacgttcgcatccttgacggtggtttccagaagtgggaagaccatgagctgggacacgctggcgggcctggaaacttcccgcacttttgcaatgtgcgtcccaacccaggtcagctgtcggtagcgaccatcgaagatgtcaaggcacatcagggcattttgattgattctcgcgatgaacaacgatttgcgggtcgcagtgaaaagctcgatctgaaagccggacacattccaggcgctatcaacatcaacgctaaatctttgctggaagatgatttcaccttcaaatcaccagaagaaatccgccagatttttgcggacaagggggtaaccagcggagagaacgtcatcgtttattccggttccggtaaccactcgtcccagttgctggctggcatggagcacgcggggctaaccggtgcgagccattattttgctggttggtcacagtggagcgctaaccccgagaatcctatcgaggcctaaaatcgtggcttgagtacgca

SEQ ID NO: 354 - protein, 274 aa, Corynebacterium glutamicum
MTVLISPSTLAESIHAGKKQTVLAAFWAPIEGAGRTVFCSEHIPTSIFCDPALELSGVPSSEDGRNPLPPLNVLARSFRTWGLNTDREIVFYDQGRGLFAARAWWILRWAGMPNVRILDGGFQKWEDHELGHAGGPGNFPHFCNVRPNPGQLSVATIEDVKAHQGILIDSRDEQRFAGRSEKLDLKAGHIPGAININAKSLLEDDFTFKSPEEIRQIFADKGVTSGENVIVYSGSGNHSSQLLAGMEHAGLTGASHYFAGWSQWSANPENPIEA

SEQ ID NO: 355 - DNA, 746 bp, Corynebacterium glutamicum
  CDS (1)..(723): RXN02334
gtcaaagacctcaacgatcccctcacccgcgatttcattgacggtgaagctttcgctgagctgatgaaccgcaagggcatcgctcgcgatgacaccgttgttgtctacggtgacaagtccaactggtgggctgcgttcaccctgtgggtcttcgaactgttcggccactccgatgtccgcctgctcaacggcggccgcgacgcgtggatggctgaagagcgcgacacctcctacgtggttccggagtacccctccgccaactaccccgtcgtggagcgtgtcgacgaaaaccagcgcgcgttcgtggctgaggtgctcggttcgctcacgcaatccggtggcatgacgcttgtcgacgtcaggaccccttcggagttctccggattggatgagcacggcaacccaacctcaaacaccggcgtgcttcgtggtggacacatcccaggcgcgatcaacctggattggtcggacgctgttcttcccaacggaaacttccgcacccgtgcagagttggacaagctctacgccgatctcaacccagctgacgataccgttgtctactgccaggttggcgaccgcgcggcccacacctggttcgtgctgaagtatctgctcggtttcaacaacgtccgaaactatgacggatcgtgggcagaatggggcaatatggttcgcatgccgatcgaaactggcgaaaacaccaaaaataacgtttcggtgtcatagaataggcgtatccccttttt

SEQ ID NO: 356 - protein, 241 aa, Corynebacterium glutamicum
VKDLNDPLTRDFIDGEAFAELMNRKGIARDDTVVVYGDKSNWWAAFTLWVFELFGHSDVRLLNGGRDAWMAEERDTSYVVPEYPSANYPVVERVDENQRAFVAEVLGSLTQSGGMTLVDVRTPSEFSGLDEHGNPTSNTGVLRGGHIPGAINLDWSDAVLPNGNFRTRAELDKLYADLNPADDTVVYCQVGDRAAHTWFVLKYLLGFNNVRNYDGSWAEWGNMVRMPIETGENTKNNVSVS

SEQ ID NO: 357 - DNA, 377 bp, Corynebacterium glutamicum
  CDS (1)..(354): FRXA02334
ggagttctcccggattggatgagcacggcaacccaaccctcaaacaccggcgtgcttcgtggtgaacacatcccaggcgcgatcaacctggattggtcggacgctgttcttcccaacggaaacttccgcacccgtgcagagttggacaagctctacgccgatctcaacccagctgacgataccgttgtctactgccaggttggcgaccgcgcggcccacacctggttcgtgctgaagtatctgctcggtttcaacaacgtccgaaactatgacggatcgtgggcagaatggggcaatatggttcgcatgccgatcgaaactggcgaaaacaccaaaaataacgtttcggtgtcatagaataggcgtatccccttttt

SEQ ID NO: 358 - protein, 118 aa, Corynebacterium glutamicum
GVLPDWMSTATQPSNTGVLRGEHIPGAINLDWSDAVLPNGNFRTRAELDKLYADLNPADDTVVYCQVGDRAAHTWFVLKYLLGFNNVRNYDGSWAEWGNMVRMPIETGENTKNNVSVS

SEQ ID NO: 359 - DNA, 3945 bp, Corynebacterium glutamicum
  CDS (101)..(3922): RXN01499
gcagcaattatctccaccgaagaggactaaatataacgtggcattgagcagtgttccagcacagttcctgagatccgcccaggcgcccccgaagcgtactttgtgggacgtcttagaatccgtcgcctctacttatcctgaggcagcagctattgacgatggccaggtgttgacctacgcagagttgatggaagaagtcaccgcgttggctgattccattcatgcacagggcattcgccgtggtgatcgcatcggtattcgcatgccgtctggtacgcgtgacctttacatcgctattttggccactctcgctgctggtgctgcttacgtgccagttgatgcagatgatcctgaagagcgcgccgagatggtgtttggtgaagcaaatattaatgcgcttttcgacgccaccggcttccatatgcttcgcccgaccgcgggcggcgatacccgtagaccacgcttggatgatacggcgtggattatctttacttccggttccaccggcaagcctaagggtgtggctgtgtcccaccgttcagctgcggctttcgtggatgccgaagcacaaatgttccttgtcgatcacccttccggcccccttggcccagaagaccgagtccttgcgggattgtctgtagcctttgacgcatcttgtgaggaaatgtggttggcctggggccacggcgcctgcttggtgccagcaccacgctccctagtccgttccggtatggacttgggcccatggctgattcgccgcgacatcagtgtcgtctccaccgtcccaactctggctggtctgtggccagcagaagcattgtcacaggtccgcttgctcatcgtcggcggcgaggcttgctcgcaggagctcgttgaacgcttatcgacgcctgaccgcgaggtgtggaacacttacggccccaccgaagcaacggtggttgcctgtggcactcaactctatgctggtcagccagtgggcattggtttgccacttgctggttgggatcttgttgttgtcgacgatgccggcgaacctgtcggaatcggcgaggtcggcgaattggtcatcggtggtgtgggtcttgcacgctaccttgatccagaaaaagaccgcgagaagtatgcgccactgaagtctgttggttggacccgcgcttatcgttccggtgaccacgttcgtctggaagaagatggcctctactttgtgggccgcgttgatgatcaggtgaaaatcggcggtcgacgcatcgagctcggtgaagttgatgccaatgtggcagcgctttccaacgttcgttcctccgcagtggttgttcagaccactggtgcggatcaaaaagttctggttgcatacgtttctttggaagatgctgcagctggatttgatcacaacgtcgcgactgcccgactcaccgaaaccatgcctgctgctttggttccgcgcattcacgtgatggatgatctgcctgtcaccacctccggcaaggttgataagaagtctttgccgtggcctcttcctggcaccgtggtggaagctaatgacctcagcgcaacggaagcgtggattgctcaggaatgggtcgatatcctcggcacttctgtgagcagcaaagacgccgacttcttctcccttggcggtacctctctcgcggctgcgactttggttggccgggtacgcgcaaaggttcccaccgctgcggtgcgtgatctttacgatcaccctcgcttggagaaattcgccgagcgtgtcgaggctatcgccgccgacactggcatttctttggaggcgccaaaccaggtggaggagcgcgtcgtcaagcctgtttcttttggcactcgtgtgatgcagaccctcatccagattccgatcatgacgctgcaagcagcacagtggattgcatggttgctgttgggcaacaacatcatggcagcgcttgatttcgattgggctgttcatgtctcctggtggcttgtcatcggcatgattttggtgttcgctaccccgattggtcgcttgccgatcggcggttggggcgcccgcatcatcacccgtggcataactcctggctcctaccctcgtggcggttccactcacctgcgcatttggtccgccgagcgccttgctgatgcctctggctctcgcaatatttctggcgcaacctgggtgaactacttcgcgcgttccctgggtgtgaagatgggcaagggcgtggatcttcactccctgccaccaatcactggccttttgaccttgggcaacaatgtttccatcgagcaagaagttgaccttcgtggctactggctcgacggcgatatcctgcgtgtaggcaccattgaggtccatgacaacgctcgcatcggcgctcgttccaccctgcttcccggcaccgtggtgggcaccggcgctcacctgctgcctggttcaacagtgactggtgataagaccatcaagcctggttctcgttgggctggctcccctgcacaaaaggtgggtcgtgcaaagcaccggttcccaacctcccatcctccacgcaggtcccggtgggttccggtgttcggcgcgacctccatcgtgttgtcgctgctgccacttcaggctctcgctattggcgctgctatcaccttgtggctggccacgattagcccgcttccactgatctggggtgtgctggtttttgctaccgtcggcgcgttggctgcgttctttgcttacaccgtgaccatctgggtgcttgtccgtttgatccagatcggcatcaagggcggcaccgcaccagtgaggtcccgtcttggttggcaggtctgggcagttcaacgcctcatggacgatgcccgcacctatctcttcccgctctacgcatcccaactgaccccactgtggttccgcagcttgggcgcgaagatcggcaaggatgttgagatctccaccgcggtgatggttcctaaactggctgatatccgcgaaggcgcattcctggccgatgacaccctcatcggtggctatgagctgggtaatggttggctgctcagtggtgaaacccgcgtgggtaagcgttccttcattggtaactctggcatcgcaggacctgagcgcaagctcgctaagaactccctggttgcagtgctctcctccaccccgaagaaggctaaggccaactccaactggtggggttcccctccagagcgcatgcgtcgtgtcactgtcgaagttgatgagggcgaagcaaagacctacagccctggctttggtgtgaagtttgcacgtggcgcggtggaaaccgcacgtctgcttgctccaataacctctggtgtgttggctgcgctgtcactgctgctcatgcagtacctgctcactgagttcaacatgtggatcacctggttgcttggcggactgatcctcatgacggttggtgtgctcgccatgggcattacggttgtgatgaagtgggtttgcgtcggcaagcataagccgtctgagcaccctctcttcagccgctttgtgtggctgaatgagctgcaagatgcgttcgtggaatccgtggctggcccatggttcctcgtgcccaacctgggcaccggcgcgctgaacgccggcatgagcgcgcttggcgcacacatcggccgtggcgcatggatcgaatcctactggctgccggaaaccgacctctgctacatcggcaagggcgcaaccgtgggccctggcgtggtcgtgcagacccacctcttccaggaccgcgtgatgagcctagatacggtgaccgtcgctgacggcgccaccctagcggaccactccgttgcccttcctgcttcgcttatcgacgcctccgccaccatcggcccaggctcgctggtgatgcgcggcgacaaggtaccagcgcatacccgctggcaaggcaacccaattgagccgtggagcaactcttaaataacaacaatcagccggat

SEQ ID NO: 360 - protein, 1274 aa, Corynebacterium glutamicum
LWDVLESVASTYPEAAAIDDGQVLTYAELMEEVTALADSIHAQGIRRGDRIGIRMPSGTRDLYIAILATLAAGAAYVPVDADDPEERAEMVFGEANINALFDATGFHMLRPTAGGDTRRPRLDDTAWIIFTSGSTGKPKGVAVSHRSAAAFVDAEAQMFLVDHPSGPLGPEDRVLAGLSVAFDASCEEMWLAWGHGACLVPAPRSLVRSGMDLGPWLIRRDISVVSTVPTLAGLWPAEALSQVRLLIVGGEACSQELVERLSTPDREVWNTYGPTEATVVACGTQLYAGQPVGIGLPLAGWDLVVVDDAGEPVGIGEVGELVIGGVGLARYLDPEKDREKYAPLKSVGWTRAYRSGDHVRLEEDGLYFVGRVDDQVKIGGRRIELGEVDANVAALSNVRSSAVVVQTTGADQKVLVAYVSLEDAAAGFDHNVATARLTETMPAALVPRIHVMDDLPVTTSGKVDKKSLPWPLPGTVVEANDLSATEAWIAQEWVDILGTSVSSKDADFFSLGGTSLAAATLVGRVRAKVPTAAVRDLYDHPRLEKFAERVEAIAADTGISLEAPNQVEERVVKPVSFGTRVMQTLIQIPIMTLQAAQWIAWLLLGNNIMAALDFDWAVHVSWWLVIGMILVFATPIGRLPIGGWGARIITRGITPGSYPRGGSTHLRIWSAERLADASGSRNISGATWVNYFARSLGVKMGKGVDLHSLPPITGLLTLGNNVSIEQEVDLRGYWLDGDILRVGTIEVHDNARIGARSTLLPGTVVGTGAHLLPGSTVTGDKTIKPGSRWAGSPAQKVGRAKHRFPTSHPPRRSRWVPVFGATSIVLSLLPLQALAIGAAITLWLATISPLPLIWGVLVFATVGALAAFFAYTVTIWVLVRLIQIGIKGGTAPVRSRLGWQVWAVQRLMDDARTYLFPLYASQLTPLWFRSLGAKIGKDVEISTAVMVPKLADIREGAFLADDTLIGGYELGNGWLLSGETRVGKRSFIGNSGIAGPERKLAKNSLVAVLSSTPKKAKANSNWWGSPPERMRRVTVEVDEGEAKTYSPGFGVKFARGAVETARLLAPITSGVLAALSLLLMQYLLTEFNMWITWLLGGLILMTVGVLAMGITVVMKWVCVGKHKPSEHPLFSRFVWLNELQDAFVESVAGPWFLVPNLGTGALNAGMSALGAHIGRGAWIESYWLPETDLCYIGKGATVGPGVVVQTHLFQDRVMSLDTVTVADGATLADHSVALPASLIDASATIGPGSLVMRGDKVPAHTRWQGNPIEPWSNS

SEQ ID NO: 361 - DNA, 609 bp, Corynebacterium glutamicum
  CDS (101)..(586): RXN01997
aaaaaggtgggaaacttagccaatccaaagcccaaaaatgcgggttatgctgcgctaacctatgctgacagccttgcggaagttgtgtacgttaggggccatgacaatcaacgagaagatcgcatcagctttcaacaaccaagtgactgcagagcttgaagcttcaatggtgtaccttcagctctcctacgttctagacgatctgggcctcaccggcatgcgcgactggatgaaggcacagagcaaagaagagctcgaacacgcacagaagttcgctcagcaccttcttgaccgtgactacaccccacagatcggtgacattgcaccaccaaagcttgatgtcacctccgctatcgaggctttcgaggcttccctggcacacgagcagaagatctccggcctgatccgcgagctcgctgccatccaggacgctgagaaggactacgattcccgcgcactgatcgactggttcctcaacgagcagatcgaagaagaagcaaccgtcggcgagatcatcgaccgcctccgtatcgctggtgattccggttccggaatcctgcgcatcgacggcgaactcggctcccgctaaattccccgcagtttttaatg

SEQ ID NO: 362 - protein, 162 aa, Corynebacterium glutamicum
MTINEKIASAFNNQVTAELEASMVYLQLSYVLDDLGLTGMRDWMKAQSKEELEHAQKFAQHLLDRDYTPQIGDIAPPKLDVTSAIEAFEASLAHEQKISGLIRELAAIQDAEKDYDSRALIDWFLNEQIEEEATVGEIIDRLRIAGDSGSGILRIDGELGSR

SEQ ID NO: 363 - DNA, 867 bp, Corynebacterium glutamicum
  CDS (101)..(844): RXA01848
ctgcaaggaactgcgcaggcgaaggcgcagactactggaaaggtaggtactgccggatccggcgacccctttcgctcctaggcatttgcgcctggcgtccatgggggaggaggactccaccccaggtaggcgttccaaggcgtattcgcgccagggcgctgatgtccgccccatgaagggtggacacggcatcaacttagtgggcacgctcatggcggctacggaacgcggcgccaacattgttgaaggcgtggtcgatttccggcccacggacctgcggggttcgctgcgccgtgggcgcgaagccaacctcatcgtgttcgtcgtcgacacatcggggtcgatggctgcgcgttccagggtgcgtgcggtcaccgggactattacctctatgcttaacgacgcctaccagcgccgcgacaaggttgcggttatcgcggtcaacggcaacaagccgacactggtgttgaatccaacaaattctgtggagcaagctcagcagaaattaaaggatatgccgatgggtggtcgcactccactggcagaggggctgctcatggccaaggatctcatggcaagggaactccgaaaggaacccggccgacgcgcgatcctcatggtgatgaccgatggccaagacacctccgatgccggcgaagcaggcattgccaccgcggcggaaacagtggtgaaatcacgactgtccggcaacgtggtcatcgactgcgaaggccgactcaaagtgcgcaaagagcgcgccggggtgttggctgaaatgctcggtggtgtgtgcgtgagattgcgtgatcttaactccgagcacatcaaaatggtgattaacgcctagacaaccagagtgagggtttc

SEQ ID NO: 364 - protein, 248 aa, Corynebacterium glutamicum
MGEEDSTPGRRSKAYSRQGADVRPMKGGHGINLVGTLMAATERGANIVEGVVDFRPTDLRGSLRRGREANLIVFVVDTSGSMAARSRVRAVTGTITSMLNDAYQRRDKVAVIAVNGNKPTLVLNPTNSVEQAQQKLKDMPMGGRTPLAEGLLMAKDLMARELRKEPGRRAILMVMTDGQDTSDAGEAGIATAAETVVKSRLSGNVVIDCEGRLKVRKERAGVLAEMLGGVCVRLRDLNSEHIKMVINA

SEQ ID NO: 365 - DNA, 1224 bp, Corynebacterium glutamicum
  CDS (101)..(1201): RXN01849
aaaaccttaagttgggtggttaaacccactaaggtctcactttatggatgtgccaggtcacaccaaaaaatctcaagaaaactcacattaaaggacagtaatggcgtcacaacagatccgctatccattctccgcggttgtgggacaagacgagcttcggcttgcgttgatcctcactgcgatttccccacgcattggtggcgtggtgattcgaggtgagaagggtacagcgaaaactaccactgtgcgtgcttttgctggtcttttaggtgatgcccctttggtgaacttgcctctcggatccacggaggatcgtgtggtgggttccctcaacatggaaactgtgttgaccaccggccgtgcggaatatcagccaggtttgctcgcgcaggctgatggcggtgtgctgtatgtcgatgaggtcaacctcttggcggatcacctggtggatgctctgctcgatgcagctgcaagcggtcgcgtcagcattgagcgtgacggtatttcgcattcttcaccagcaaactttgtgttggtgggcaccatgaatccggaggaaggcgagctgcgcccgcagctgctggaccgtttcggtttggctgtggacgttgctgcgtctacgaaccctgaggtgcgcgtggagatcattcgccgccggcttgattttgaaaacgctcctgagcagttcatggctaagtgggctgagcaagatgcggacacctccaaccgtattttggcggctaaggatttgctgcctggtgtggagctgccggatctgatcttgtcgcagattgcgtggttgtgtgcacgtattgaagtcgacggtatgcgcgctgacctggtgatcacgcgtaccgcacttgctcacgccgcgtgggctggacgcactgtggttacggaagaagacgtggagatcgcagctcgcctagcgttgccgcaccgccgtcgccgtaatcctttcgatgctccagaaatggaggagcgcaagcttcaggaaaccctgcaggaagctcgggacttcttcaaagacaatgaagataaaggacctgccgccaagatcaccgatgaggaaaccggtgcagaggcctttaccgataccgacaatcccaccgaggaagacggtctgcaaggaactgcgcaggcgaaggcgcagactactggaaaggtaggtactgccggatccggcgacccctttcgctcctaggcatttgcgcctggcgtcca

SEQ ID NO: 366 - protein, 367 aa, Corynebacterium glutamicum
MASQQIRYPFSAVVGQDELRLALILTAISPRIGGVVIRGEKGTAKTTTVRAFAGLLGDAPLVNLPLGSTEDRVVGSLNMETVLTTGRAEYQPGLLAQADGGVLYVDEVNLLADHLVDALLDAAASGRVSIERDGISHSSPANFVLVGTMNPEEGELRPQLLDRFGLAVDVAASTNPEVRVEIIRRRLDFENAPEQFMAKWAEQDADTSNRILAAKDLLPGVELPDLILSQIAWLCARIEVDGMRADLVITRTALAHAAWAGRTVVTEEDVEIAARLALPHRRRRNPFDAPEMEERKLQETLQEARDFFKDNEDKGPAAKITDEETGAEAFTDTDNPTEEDGLQGTAQAKAQTTGKVGTAGSGDPFRS

SEQ ID NO: 367 - DNA, 473 bp, Corynebacterium glutamicum
  CDS (1)..(450): FRXA01849
ctgcctggtgtggagctgccggatctgatcttgtcgcagattgcgtggttgtgtgcacgtattgaagtcgacggtatgcgcgctgacctggtgatcacgcgtaccgcacttgctcacgccgcgtgggctggacgcactgtggttacggaagaagacgtggagatcgcagctcgcctagcgttgccgcaccgccgtcgccgtaatcctttcgatgctccagaaatggaggagcgcaagcttcaggaaaccctgcaggaagctcgggacttcttcaaagacaatgaagataaaggacctgccgccaagatcaccgatgaggaaaccggtgcagaggcctttaccgataccgacaatcccaccgaggaagacggtctgcaaggaactgcgcaggcgaaggcgcagactactggaaaggtaggtactgccggatccggcgacccctttcgctcctaggcatttgcgcctggcgtcca

SEQ ID NO: 368 - protein, 150 aa, Corynebacterium glutamicum
LPGVELPDLILSQIAWLCARIEVDGMRADLVITRTALAHAAWAGRTVVTEEDVEIAARLALPHRRRRNPFDAPEMEERKLQETLQEARDFFKDNEDKGPAAKITDEETGAEAFTDTDNPTEEDGLQGTAQAKAQTTGKVGTAGSGDPFRS

SEQ ID NO: 369 - DNA, 667 bp, Corynebacterium glutamicum
  CDS (101)..(667): FRXA01691
aaaaccttaagttgggtggttaaacccactaaggtctcactttatggatgtgccaggtcacaccaaaaaatctcaagaaaactcacattaaaggacagtaatggcgtcacaacagatccgctatccattctccgcggttgtgggacaagacgagcttcggcttgcgttgatcctcactgcgatttccccacgcattggtggcgtggtgattcgaggtgagaagggtacagcgaaaactaccactgtgcgtgcttttgctggtcttttaggtgatgcccctttggtgaacttgcctctcggatccacggaggatcgtgtggtgggttccctcaacatggaaactgtgttgaccaccggccgtgcggaatatcagccaggtttgctcgcgcaggctgatggcggtgtgctgtatgtcgatgaggtcaacctcttggcggatcacctggtggatgctctgctcgatgcagctgcaagcggtcgcgtcagcattgagcgtgacggtatttcgcattcttcaccagcaaactttgtgttggtgggcaccatgaatccggaggaaggcgagctgcgcccgcagctgctggaccgtttcggtttggctgtggacgttgctgcgtctacgaaccctgaggtgcgcgtggagatcattcgccgccggcttgatttt

SEQ ID NO: 370 - protein, 189 aa, Corynebacterium glutamicum
MASQQIRYPFSAVVGQDELRLALILTAISPRIGGVVIRGEKGTAKTTTVRAFAGLLGDAPLVNLPLGSTEDRVVGSLNMETVLTTGRAEYQPGLLAQADGGVLYVDEVNLLADHLVDALLDAAASGRVSIERDGISHSSPANFVLVGTMNPEEGELRPQLLDRFGLAVDVAASTNPEVRVEIIRRRLDF

SEQ ID NO: 371 - DNA, 601 bp, Corynebacterium glutamicum
  CDS (101)..(601): RXN00665
accaaacacttctgtgcgtgacacgcgccaccttatactcccacaagcaacacagaacactcgggatctcaaagtttcgagaaacacagaaagggcagcaatgagcagctcaacacttctcctggcttcaggacaagtcacggcattagccgctgactacacgctcagccacaccccctcagatggcatcctggtagtccttggcttcgccatgatcctcaccttcatgaccctgatcatgctgggtcgactcaccccaatggtggccatgctgttggtccccaccatcttcggtctcatcgccggcgcaggactcggccttggtgacatggcgcttgacgccatcaaggacatggcgcctaccgcggcactcctgatgttcgcgattatgttcttcggaatcatgatcgacgtcggactcttcgaccccctgatccgcgtgatcacccgcgttcttcacgatgaccccgcaaaggtcgtcatcggcaccgcagtacttgcaggtgttgtctccctcgacggcgacggctccaccaccttcatcattaccaccttccgcgatgctgcccatctacctgcgccttggcatgagccctgtggt

SEQ ID NO: 372 - protein, 167 aa, Corynebacterium glutamicum
MSSSTLLLASGQVTALAADYTLSHTPSDGILVVLGFAMILTFMTLIMLGRLTPMVAMLLVPTIFGLIAGAGLGLGDMALDAIKDMAPTAALLMFAIMFFGIMIDVGLFDPLIRVITRVLHDDPAKVVIGTAVLAGVVSLDGDGSTTFIITTFRDAAHLPAPWHEPCG

SEQ ID NO: 373 - DNA, 390 bp, Corynebacterium glutamicum
  CDS (101)..(367): RXN03026
gttggcggcgcagtatcgtgaggtgcgggacctcgagcggggaatcccaaactagcatcccgaactagccccccaacaacaattagaaatggaacctaaaatgcctggaaaaattctccttctcaacggcccaaacctgaacatgctgggcaaacgcgagcctgacatttacggacacgacaccttggaagacgtcgtcgcgctggcaaccgctgaggctgcgaaacacggccttgaggttgaggcgctgcagagcaatcaccaaggtgagctaatcgatgcgctgcacaacgctcgcgggacccacatcggttgcgtgattaaccccggcggcctgactacacttcggtggcgcttttggatgctgtgaaggcgtctgagcttcctacc

SEQ ID NO: 374 - protein, 89 aa, Corynebacterium glutamicum
MPGKILLLNGPNLNMLGKREPDIYGHDTLEDVVALATAEAAKHGLEVEALQSNHQGELIDALHNARGTHIGCVINPGGLTTLRWRFWML

SEQ ID NO: 375 - DNA, 384 bp, Corynebacterium glutamicum
  CDS (101)..(361): RXN02908
gccaacgagggttggtttaccacctctgattcaggtgaactccacgacgggattctcaccgtgactggtcgcgtggatacccgtcattgattccggtggattgaagttgcacccagaggtactggaacgtgccatcgcagatattaaaggtgtcaccgcggcgtgtgttgtgggtattcccgatccccgattaggccaagcaattgtggccgcgtactccggatcgatcagtccgtctgaagttattgaaggcctcgacgatctacctcgttggcagcttcccaaacggctgaagcatctggaatctttgcccagcattggtcctggaaaagctgatcgacgtgctatcgcgaagctgttttagtcttcattcttgctggctgc

SEQ ID NO: 376 - protein, 87 aa, Corynebacterium glutamicum
LKLHPEVLERAIADIKGVTAACVVGIPDPRLGQAIVAAYSGSISPSEVIEGLDDLPRWQLPKRLKHLESLPSIGPGKADRRAIAKLF

SEQ ID NO: 377 - DNA, 667 bp, Corynebacterium glutamicum
  CDS (101)..(667): RXN03000
cagcgtgttgctgcgcctgcagaaaacctacagcgtcacccacaaagtcgaaatccaaggctaaccccctttttcaactcacagttaggaaacttcacccatgtctcttccacattctgatgaactccgcggccaaaagatcattatttccggtggcggaattggtggcgcagcaggtgcacttgcgcttgctttgcgcggtgccgatgtcactttgtacgaacgcgcagctgagttcaaggaggtcggcgctggcctccagatcggtccgcacggctggcgaatgctggaatcctggggtctgctcgaccaaattgtcgtggccggctacctcccagaagacatgcagttccgcgacgctgtcaaccgcgaaaccatcctgaccatgcgtttcgatgaagaattccagcagcactacggcggtcgctacctggtgattcaccgctctgacctgctcaacatcctggtcaccaacgccgaagcagcgggcgcgaagctccacaatggcgtcctggtcaccgattcccgcaccgtcgacggcggtatcgaggtggacatcgaatcctccatcaacaagggcgaagataacaagactttgcttgtcgacgccttcctcgccttcgacggcatccactcggtcatgcgcaaaaagcttgtcgacgacgcc

SEQ ID NO: 378 - protein, 189 aa, Corynebacterium glutamicum
MSLPHSDELRGQKIIISGGGIGGAAGALALALRGADVTLYERAAEFKEVGAGLQIGPHGWRMLESWGLLDQIVVAGYLPEDMQFRDAVNRETILTMRFDEEFQQHYGGRYLVIHRSDLLNILVTNAEAAGAKLHNGVLVTDSRTVDGGIEVDIESSINKGEDNKTLLVDAFLAFDGIHSVMRKKLVDDA

SEQ ID NO: 379 - DNA, 766 bp, Corynebacterium glutamicum
  CDS (101)..(766): RXN03036
tagaaaaatctacccagtaagcattcaggaaccattcagaatcttttcttagcatgtctctatcagcgtaaacgtccgaacatgaaaggctagaaaagccatggctgagcagttgcgtcaatttgaaggcagggtcctccctaatcaatccgaggacttggaagatcagggtttgggatttgacctgggaaccgttttctcccgcaggaaggttttgggattcatcggtgttggtggagcaggtgtggcacttgctgcttgttcaccttctggttcttccgcggcatcgagcacctcaagcgcgtccagcagcgcagctgcaaccaccagtgcagcagcagagactttgactgagatgaagtcggagactgctggtccgtacccgggcgatggttcgaatggtccggatgtgttggaggtctccggtgtggagcgccaggacatcaccaagtcgattgattctgacaccgtggcagagggcgtacctctgacgttgactatgaccattttggacatgaacaacaacaatcagccaatggagggtgctgcggtgtacgtgtggcactgtgatgcgccgggtcgatattcgatgtacgactctgagctggaagatgagacctatttacgcggtgtgcagattaccgataagtatggccaggtcacgttcgataccattttccctggttgttatgcgggccgttgggtgcatattcatttcgaggtgttcccggatcgagacagcatcacggattccacgaacaacatt

SEQ ID NO: 380 - protein, 222 aa, Corynebacterium glutamicum
MAEQLRQFEGRVLPNQSEDLEDQGLGFDLGTVFSRRKVLGFIGVGGAGVALAACSPSGSSAASSTSSASSSAAATTSAAAETLTEMKSETAGPYPGDGSNGPDVLEVSGVERQDITKSIDSDTVAEGVPLTLTMTILDMNNNNQPMEGAAVYVWHCDAPGRYSMYDSELEDETYLRGVQITDKYGQVTFDTIFPGCYAGRWVHIHFEVFPDRDSITDSTNNI

SEQ ID NO: 381 - DNA, 318 bp, Corynebacterium glutamicum
  CDS (101)..(295): RXN02974
gcaggcatggacacattccaggtcctgaccggcgtcagcggctactacgatttggtgcgcgccattcccagagcagcgccccacctatatcgccacctcgatgcaggatctctacagcgatccgggcgagctcaagccaggtgcccagggcggtttttcagcgcttatcgacggcgacaccctggtcatttccggcggcgatgccggcgcaactccggttgcagcactccgcactgcgttggatgtggcctgggcggccacagagcagtcaccgaggtacgcgctgattcagaggtagctgctactgcattgcagagc

SEQ ID NO: 382 - protein, 65 aa, Corynebacterium glutamicum
MQDLYSDPGELKPGAQGGFSALIDGDTLVISGGDAGATPVAALRTALDVAWAATEQSPRYALIQR

SEQ ID NO: 383 - DNA, 1017 bp, Corynebacterium glutamicum
  CDS (101)..(994): RXN00393
tctattcatttcacaatagcgtttcacactcccccatagcctgccgaacgtatttcaagcaattgcgcgatcgagtatgtgatggggaaagatagaggttatgtctcacacggaaccccagccgaattctgtaactttgtccgattggattcaaggcgcacgcccgcgtacctgggcaaatgcgttcgcgcctgtcattgccggttcaggtgtcgccgcttttcatgatggttttgtgtggtggaaggccttgctggcgcttgtcgtggcgtgggctttgatcatcggtgtgaattacgccaatgattactctgatggcattcgtggcaccgatgaagaccgcaccggtcctctgcgactcactggttctgggttggctgagccgaagaaagtgaaagctgcggcgtttatttctttcggtatcgcaggtgtcgccggcaccgcgctgagcctgttgagcgcgtggtggctgatcctcatcggcatcctgtgtgtgctgggcgcgtggttctacaccggcggtaaaaatccttatggttaccgcgggctcggcgagattgctgtgttcatcttcttcggcctcgtcgcggtcatgggaacgcagttcacccaaaccggttccgtcagctgggccggtttggccgccgcagttggcgtggggtcgatgtctgctggcgtgaacttggccaacaatattcgcgatattccaaccgatagcaagaccggaaaaattaccctcgcggtccgcctgggcgatgcgggtgctcgtaagctgttcctcgcgctgatttccacgccgttcatcatgtccatctgcctggcgtttgtcgcctggccagcgctgatcgcgatcatcgttttcccgctggcactgaaagccgcagggccgatccgcaacaacgccaccggcaaggatctcatccccgtcatcggctcaacagggcgcgccatggcgttgtgggccgtgctcacgggcctggcattagcgtttagctaaaacgcttttcgacgctcccc

SEQ ID NO: 384 - protein, 298 aa, Corynebacterium glutamicum
MSHTEPQPNSVTLSDWIQGARPRTWANAFAPVIAGSGVAAFHDGFVWWKALLALVVAWALIIGVNYANDYSDGIRGTDEDRTGPLRLTGSGLAEPKKVKAAAFISFGIAGVAGTALSLLSAWWLILIGILCVLGAWFYTGGKNPYGYRGLGEIAVFIFFGLVAVMGTQFTQTGSVSWAGLAAAVGVGSMSAGVNLANNIRDIPTDSKTGKITLAVRLGDAGARKLFLALISTPFIMSICLAFVAWPALIAIIVFPLALKAAGPIRNNATGKDLIPVIGSTGRAMALWAVLTGLALAFS

SEQ ID NO: 385 - DNA, 1242 bp, Corynebacterium glutamicum
  CDS (101)..(1219): RXN00948
acaccctccaaatgatctcgtaaaacagtattgaatttaggtacgactctaatcgtaccttgccctcaagccaagctagttgtacgatcaaactcgttgtatggcaaacgtcgtactagtcgatcgaatggagcctttggtgtccaagctgtttaccccaattcaaatccgcgacatcaccatccccaaccgcgtgtggatgtcaccgatgtgcacctactctgcagccaccggttcaggtcttcccaccgattttcaccaggctcattacgcagctcgcgcagcaggtggtgtcggattagtcatggttgaagcaactggagtgaaccccgtagctcccatctccccagtcgaccttggactttggagccatgaccaaattgaaccattctcccgagtgacagcagctattcgcgccggtggggcagtaccggccgttcaattagcccatgctggccgcaaggcatccaccgatgctccgtggaatggtggcggatatgttggaccagaaaccaatggatgggagactgtcggccccagccctctggcattcccaggtttgcctgctccgcgcgagctgacggtttcagaaatccaagaggttgtgcagcagttcgctggcgccgccgttcgtgccgatcaggctggttttgatgtcgtggaaattcacgcagcacacggctaccttttgcataacttcctttctccgatctccaacaagcgcaccgattcatacggcggatctttagaaaaccgcgctcgcatcgtgctcgaagtcattgatgcaatccgcgcagtgtggccagaggaaaagcctgtattcatgcgcatttccaccaccgactgggtggaggaaaacccacaggatgatcgcgagtcctggacgctgagccaaagcaggcagctggctttgtgggcatccgagcacggagttgatttgatcgatgcctcttctggtggcctcgacatcgtccccattccgcatgaccgcgattaccaaaccgcgaaggccgcagatcttcacgcaagtaccggagtgacagtcgctgctgtggggcgcattgatgacgcccaaactgcgcacaatttggttgattctggcgatgtcaatgcagttttcctcggccgtccactgctcaaggatccttcctgggcaaaccaagcagccctcgcactaggtgcggaacccaggtatgttcaccaatacgactacgtactttaaaggagagttgacatgaaggt

SEQ ID NO: 386 - protein, 373 aa, Corynebacterium glutamicum
MANVVLVDRMEPLVSKLFTPIQIRDITIPNRVWMSPMCTYSAATGSGLPTDFHQAHYAARAAGGVGLVMVEATGVNPVAPISPVDLGLWSHDQIEPFSRVTAAIRAGGAVPAVQLAHAGRKASTDAPWNGGGYVGPETNGWETVGPSPLAFPGLPAPRELTVSEIQEVVQQFAGAAVRADQAGFDVVEIHAAHGYLLHNFLSPISNKRTDSYGGSLENRARIVLEVIDAIRAVWPEEKPVFMRISTTDWVEENPQDDRESWTLSQSRQLALWASEHGVDLIDASSGGLDIVPIPHDRDYQTAKAADLHASTGVTVAAVGRIDDAQTAHNLVDSGDVNAVFLGRPLLKDPSWANQAALALGAEPRYVHQYDYVL

SEQ ID NO: 387 - DNA, 873 bp, Corynebacterium glutamicum
  CDS (101)..(850): RXN01923
ccaaagtgaataccccgactgcagcagcgcaaaagttcaagtactttgggatgcaaatctagtagcacgtcccatgtttctcacactctcaggagctgacatgtctgcacttattaaaggttcaggacctcatcatgtggttgtcttaaatggttggtttggtcatgctgcgggctggggagctttcgctgactatcttgacctcggcaactacacctggcacttttgggattaccgaggttacggcaacagaaaagacgacgcaggagaatttactctggaggaaatttcagcggatatcgttgcatacatcgactcgattgaggcagaaaaggtttccatcctgggccattccatgggtggagtgttcatgcagaaagtccttgcagacagcgccacccccatcgcttcactggttggaatttctgccgttgctgcagctggaacaccattcgatgaggattctcggaagcttttcacctcagcagggcacaacccggactcgaggcgagccatcatcgatttcacctcaggatctcgccaacctgccgcgtggttggatgatctcaccgactcggcggtgcagaattccactccagaggccgttgaaaagtacttttttgcgtgggctgattgtaatttcgcagcggatttaggcacccaagatttgcccgtggacattctcaccggcgatctcgaccccgcggtcactaaaactgccgtggaatccgcattcggcccgatctatcaaaatctgaccgttgaagaactccacgatgtcggacactacgcaattttcgagcaccccttaggccttgccgccagggtgcttcgatttctcgacgccgtctagtacttccgcaaattcaccgg

SEQ ID NO: 388 - protein, 250 aa, Corynebacterium glutamicum
MSALIKGSGPHHVVVLNGWFGHAAGWGAFADYLDLGNYTWHFWDYRGYGNRKDDAGEFTLEEISADIVAYIDSIEAEKVSILGHSMGGVFMQKVLADSATPIASLVGISAVAAAGTPFDEDSRKLFTSAGHNPDSRRAIIDFTSGSRQPAAWLDDLTDSAVQNSTPEAVEKYFFAWADCNFAADLGTQDLPVDILTGDLDPAVTKTAVESAFGPIYQNLTVEELHDVGHYAIFEHPLGLAARVLRFLDAV

SEQ ID NO: 389 - DNA, 873 bp, Corynebacterium glutamicum
  CDS (101)..(850): RXN00398
tgagttcgccaccatcagcaccggcacccaccagcgcggtgtggttaaccgtgagaagtttgtctcccgtctgcctgaagcacctaaggaaaactaaatcatggccaagttgtttgattcccatttccatatcatcgatccccagcacccactgatcgaaaacaacggctacctccccgagcctttcaccgtggaggattacactgcgcgtgttgaaggcctcgaagttgctgccggagcgattgtttccggttctttccaggctttcgaccagggctacctcaaagatgctctcgcagtgcttggcccaggctatgtcggtgtcactcagatccccgcagatacctctgatcaggagattcttgatctggacaaagctggcgtgaaggctgtgcgtttaaacttgaagcgcggtggttcggcaggtcttgacgatctcgagaccttggcacgccgagtccacgacctagccggttggcacaccgaactctatgtggatgctcgcgaactagacgagttggaatcaaccttggcctccctccctgctgtcagcattgatcacttagggctccaccgcgatggacttcccgcacttcttcgcttggtagaaaatggcattaaagtcaaagcaaccggattcggacgggtagaactagatccaactgaagtcatccaggcaatcatggctgtcgatcccactgctttgatgatcggaactgatcttccatccacccgcactaagcgacctttcgaagacgctgacctagatttgatcgctgaaacggttggcgaagatcatgtcgacaacgtcttctggaacaacgctgcagcgttctacctcggagaccagtagttttaagacccgaaatgtct

SEQ ID NO: 390 - protein, 250 aa, Corynebacterium glutamicum
MAKLFDSHFHIIDPQHPLIENNGYLPEPFTVEDYTARVEGLEVAAGAIVSGSFQAFDQGYLKDALAVLGPGYVGVTQIPADTSDQEILDLDKAGVKAVRLNLKRGGSAGLDDLETLARRVHDLAGWHTELYVDARELDELESTLASLPAVSIDHLGLHRDGLPALLRLVENGIKVKATGFGRVELDPTEVIQAIMAVDPTALMIGTDLPSTRTKRPFEDADLDLIAETVGEDHVDNVFWNNAAAFYLGDQ

SEQ ID NO: 391 - DNA, 1108 bp, Corynebacterium glutamicum
  CDS (101)..(1099): RXN02813
ggactctaaattgacccgatctttatactccgaccttgctggtagtggagaacacctcagcagcctttccgacgagactttcctaaagaatcttcttgtcgtggaggccgctttggcggttgcagctgcccccgagcacgcagcaatggcgaaggccaccattgattcttatcagttggatgtggaggagctttcccgtcgcgcagccgagggcggtaatccgctcattccgctggtcactgacctcaaggccatcaatccggcaggcatccacattggcgcaacgagccaggacatcattgattctgcgttaatgctgtgcatgaaggaaggggtgggggaggtcgtcgacaagcttaaaaagcttgcgcgagatttggccgagctcaccgcggagcataaagcaaccccgatcatggggcgcacgttggggcagatcgcgacgccgacgacgttcggcgcgctgaccggcggctggctggttgcggtggacaatgcggcacgcgccctggaggcgctggagtttccggtgtcgtatggcggtgccagcggaaatatgacggcggtgcacccgcgtggcttcgagattcaggcgaagctggccgaggagttgggcctttttgatccgcagtgggtgtggcattccgatcgcacgccgatcactgcgatcgcgtcggcgctggcaacggccgctggtgtggtacgcaaaattgctggtgacgtggtgttttactcacaaaccgaggtcggcgagttgcgggagaaatcccccggcggcagctccgcgatgccccacaaagccaatccggccgctgcgattgcgtgcgacggttacgcgcgccgggcacctggccttcttgcaacgcttttcgacgccctcgactgccgtttgcagcgcggcaccggcagctggcacgcggagtgggcaacgctgcgcgagttggctgctgtcactcactcagcagtgagcagggctgcaaccagcatcgatggcatcaccgtcaacgttgatgtgatggcaagtcgcgtcaatggaccaaccgggcacgccgaagatttggcggagcgggcactagaaatttatggaaaaggacgcagttaatggatc

SEQ ID NO: 392 - protein, 333 aa, Corynebacterium glutamicum
VEAALAVAAAPEHAAMAKATIDSYQLDVEELSRRAAEGGNPLIPLVTDLKAINPAGIHIGATSQDIIDSALMLCMKEGVGEVVDKLKKLARDLAELTAEHKATPIMGRTLGQIATPTTFGALTGGWLVAVDNAARALEALEFPVSYGGASGNMTAVHPRGFEIQAKLAEELGLFDPQWVWHSDRTPITAIASALATAAGVVRKIAGDVVFYSQTEVGELREKSPGGSSAMPHKANPAAAIACDGYARRAPGLLATLFDALDCRLQRGTGSWHAEWATLRELAAVTHSAVSRAATSIDGITVNVDVMASRVNGPTGHAEDLAERALEIYGKGRS

SEQ ID NO: 393 - DNA, 1218 bp, Corynebacterium glutamicum
  CDS (101)..(1195): RXN00136
cagtgttgcatcatctagaaatcgattaattaaaccgggcacctgattaacattgggctgcccggtttcttcctattacaagcgaaaggcaacgtgccccatgagcgcagtgcagattttcaacaccgtccacgtcaatggatcttccccctatgatgtccacattggttccggcctcaacgagctcattgttcagcgcgcagcggaatcaggcgcggagcaggtagcgattttgcaccagcccagcatggatgacattgcatccgagttggatgcagcactagtcgctgctggtttgaaggtcctgcaccttaatgttcccgatgcggaaaacggcaagtccttggaagtagcggggcagtgctgggatgaattgggtggcgcagcattcggccgccgcgatatcgtcatcggacttggtggcggtgctgccacagatctcgcgggattcgtcgctgctgcatggatgcgtggcgtgcgcgtcattcaggttccaaccaccttgttggccatggtggacgctgcggtgggcggcaagactggcatcaataccgccgcaggcaagaaccttgtgggcgcgttccacgagcctgacgcagtattcattgacaccgatcgcctagccaccctgcctgacgcggaaatcatcgcgggatccgccgaaatcatcaaaactggtttcatcgccgacccagaaatcctgcgcctttacgaaactgatcccgcagcctgcctgaagaaagaagtcgaaggctcccacctacctgaactgatttggcgctccgtcaccgtcaagggctccgtggtcggccaagacctcaaagaatctagcctgcgcgaaatcctcaactacggacacacctttgcccacgccgtcgaactccgcgaaaacttccgctggcgccacggcaatgccgttgcagtgggcatgatgttcatcgccaacctctcccacaagctcgggcttatcgacgcgcccctcctcgagcgccaccgctcaatcctggcggccatcggtctgcccacttcctacgaaggcggagccttcgacgagctttacgacggtatgacccgcgacaagaaaaaccgcgacggcaacatccgcttcgtcgcactgaccgccgtgggcgaggttacccgcattgaggggccctcaaaacaagatttacagagtgcttatgaggcaatcagccactaagtgttgagtaatctactagt

SEQ ID NO: 394 - protein, 365 aa, Corynebacterium glutamicum
MSAVQIFNTVHVNGSSPYDVHIGSGLNELIVQRAAESGAEQVAILHQPSMDDIASELDAALVAAGLKVLHLNVPDAENGKSLEVAGQCWDELGGAAFGRRDIVIGLGGGAATDLAGFVAAAWMRGVRVIQVPTTLLAMVDAAVGGKTGINTAAGKNLVGAFHEPDAVFIDTDRLATLPDAEIIAGSAEIIKTGFIADPEILRLYETDPAACLKKEVEGSHLPELIWRSVTVKGSVVGQDLKESSLREILNYGHTFAHAVELRENFRWRHGNAVAVGMMFIANLSHKLGLIDAPLLERHRSILAAIGLPTSYEGGAFDELYDGMTRDKKNRDGNIRFVALTAVGEVTRIEGPSKQDLQSAYEAISH

SEQ ID NO: 395 - DNA, 1977 bp, Corynebacterium glutamicum
  CDS (101)..(1954): RXN02508
tgcacactgctggtggtgaggccgcagacctggcagccgcaagcaaagcctccgaggcccaactcgcggctcagtaaaaccaaaaggaatctttgaccacatgcgtacatccattgccactgtttgtttgtccggaactcttgctgaaaagctgcgcgcagctgcagatgctggatttgatggtgtggaaatcttcgagcaggacttggtggtttccccgcattcggcagagcagattcgtcagcgggctcaggatttgggattaaccctggatctgttccagccgtttcgagatttcgaaggtgtggaagaagagcagtttctgaagaatctgcaccgcttggaagagaagttcaagctgatgaacaggcttggcattgagatgatcttgttgtgttccaatgtgggcaccgcgaccatcaatgatgatgaccttttcgtggagcagttgcatcgtgcagcagatttggctgagaagtacaacgtcaagattgcttatgaagcgttggcgtggggcaagtttgtcaatgattttgagcatgcgcatgcacttgtggagaaggtgaatcacaaggcgctgggaacctgcttggatacgttccatattctttcccgtggttgggaaaccgacgaggtggagaacatccctgcggagaagatcttctttgttcagttagcggatgcgccgaagctgagcatggacattttgtcctggtcgcgtcaccaccgtgttttccctggtgaaggcgatttcgatctggtgaaattcatggttcatctggccaagacgggttatgatggcccgatttctttggagatcttcaacgattccttccgcaaggccgaggttggtcgcaccgcgattgatgggttgcgttctttgcgttggttggaagatcagacctggcatgcgctaaatgctgaggatcgtccaagcgctcttgaactgcgtgcacttcctgaggtcgcggaacctgagggtgttgatttcattgagatcgccactggacgtttgggtgagaccattcgggttcttcatcaattgggtttccgcttgggtggtcatcactgcagtaagcaggattaccaggtatggacccagggcgatgtgcgcattgtggtgtgtgatcgtggggtcaccggggctccaaccacgatctctgcgatgggctttgacacccccgatccagaagctgctcatgcccgtgcggaattgctgcgggctcagacaattgatcgtccccacatcgagggcgaagttgacctaaaaggtgtgtacgcaccggatggggtggagctgtttttcgcggggccgagccccgatggaatgcccgagtggctgccggaattcggcgtcgaaaagcaagaagctggtctcattgaagccatcgaccacgtcaatttcgcccagccgtggcaacattttgatgaggcagtgctgttttacaccgcgctgatggcgttggagactgtgcgtgaggatgagttcccgagcccaattggtttggtgcgcaatcaggtgatgcgttcgccgaatgatgcggtgcggttgctgctcagcgtggcgcccgaggacggtgagcagggagatttcctcaacgcggcctacccggagcacattgcgttggccacggcggacatcgtggcggtggctgaacgtgcgcgcaaacgaggcctggatttcttgcccgtcccagagaattactacgacgatgtgcaggcgcgttttgatttgccgcaggaattcttggacacactcaaggaaaaccacctgctttacgaccgcgacgagaacggcgaattcctccacttttacacccgcacgttgggcacgctgttcttcgaagtggtggaacgccgcggcggttttgcaggttggggcgaaacaaacgctccggtgcggttggcggcgcagtatcgtgaggtgcgggacctcgagcggggaatcccaaactagcatcccgaactagcccccca

SEQ ID NO: 396 - protein, 618 aa, Corynebacterium glutamicum
MRTSIATVCLSGTLAEKLRAAADAGFDGVEIFEQDLVVSPHSAEQIRQRAQDLGLTLDLFQPFRDFEGVEEEQFLKNLHRLEEKFKLMNRLGIEMILLCSNVGTATINDDDLFVEQLHRAADLAEKYNVKIAYEALAWGKFVNDFEHAHALVEKVNHKALGTCLDTFHILSRGWETDEVENIPAEKIFFVQLADAPKLSMDILSWSRHHRVFPGEGDFDLVKFMVHLAKTGYDGPISLEIFNDSFRKAEVGRTAIDGLRSLRWLEDQTWHALNAEDRPSALELRALPEVAEPEGVDFIEIATGRLGETIRVLHQLGFRLGGHHCSKQDYQVWTQGDVRIVVCDRGVTGAPTTISAMGFDTPDPEAAHARAELLRAQTIDRPHIEGEVDLKGVYAPDGVELFFAGPSPDGMPEWLPEFGVEKQEAGLIEAIDHVNFAQPWQHFDEAVLFYTALMALETVREDEFPSPIGLVRNQVMRSPNDAVRLLLSVAPEDGEQGDFLNAAYPEHIALATADIVAVAERARKRGLDFLPVPENYYDDVQARFDLPQEFLDTLKENHLLYDRDENGEFLHFYTRTLGTLFFEVVERRGGFAGWGETNAPVRLAAQYREVRDLERGIPN

SEQ ID NO: 397 - DNA, 470 bp, Corynebacterium glutamicum
  CDS (1)..(447): RXN02839
tgtgtggtgaatgattatgctgaccgcaagtttgatggtcatgttaagcgcacggcgaaccgaccacttcccagcggcgcggtaacagagaaagaggcgcgcgcgctgtttgtcgtgctggtactgatttcgtttttactggtgctgacgctgaatacgatgaccattctgttgtcgattgccgcgctagcgctggcgtgggtgtacccgtttatgaagcggtatacccatctaccgcaagtggtgctgggcgcggcgtttggctggtcgattccaatggcttttgccgctgtgagtgagtcggtgccattgagttgctggttaatgttcctcgccaatattctctgggcggtggcttacgacacgcagtatgcgatggttgaccgcgatgatgatgtgaagattggcattaaatccacggcaatcctgttggccaatacgataaattgatattgggattttgcagattg

SEQ ID NO: 398 - protein, 149 aa, Corynebacterium glutamicum
CVVNDYADRKFDGHVKRTANRPLPSGAVTEKEARALFVVLVLISFLLVLTLNTMTILLSIAALALAWVYPFMKRYTHLPQVVLGAAFGWSIPMAFAAVSESVPLSCWLMFLANILWAVAYDTQYAMVDRDDDVKIGIKSTAILLANTIN

SEQ ID NO: 399 - DNA, 978 bp, Corynebacterium glutamicum
  CDS (101)..(955): RXN00639
agtgttgttatcgagttcagccgatcacaaagatttttccgctaggcagtgatccgactcgcaccccctacttcacccccaaagtctctaggagtatgacatgacttcagctgaacagatcgttgatccaacagcccacgattcgggcaacaaggcaactgacaagttcaaggcaaaccgcgtttcctccgatacctccaaggaacgcgcaaacgcgatctacgtagatctgctcgcggcgatcgcccaggttgctcacaagcacgaagtcacctacgaagagtacgcagtgctcaagcagtggatgatcgacgttggagaatacggcgagtggccactgtggttggacgttttcgttgagcatgagatcgaagagatcaactacaaccgccacgactacaccggaaccaagggttccatcgaaggcccttattacgtagagaactctccgaagctcccttgggatgctgaaatgccaatgcgtgacaaggaccgcgcatgcaccccactgatcttcgaggggcaggttactgacctcgacggcaacggtcttgatggagcagaagttgagctctggcacgcagatgaggacggatactactcccagttcgcgcctggaatcccagagtggaacctgcgtggcaccatcgttaccgatgaggaaggccgctacaagatcaagaccctgcagcctgcgccttaccagatccctcatgatggcccaaccggttggttcattgagtcttacggtgggcacccatggcgcccagcccacctccacttgcgcgtttcccacccgggctaccgcaccatcaccacccagctttacttcgagggtggcgagtgggtcgaaaacgacgttgcaaccgctgtgaagccagaactggtcctgcaccctgagactggcgaggatggtaaccacgttcactacccattcgtcctggataaggaagactagtttttctacctagctagcat

SEQ ID NO: 400 - protein, 285 aa, Corynebacterium glutamicum
MTSAEQIVDPTAHDSGNKATDKFKANRVSSDTSKERANAIYVDLLAAIAQVAHKHEVTYEEYAVLKQWMIDVGEYGEWPLWLDVFVEHEIEEINYNRHDYTGTKGSIEGPYYVENSPKLPWDAEMPMRDKDRACTPLIFEGQVTDLDGNGLDGAEVELWHADEDGYYSQFAPGIPEWNLRGTIVTDEEGRYKIKTLQPAPYQIPHDGPTGWFIESYGGHPWRPAHLHLRVSHPGYRTITTQLYFEGGEWVENDVATAVKPELVLHPETGEDGNHVHYPFVLDKED

SEQ ID NO: 401 - DNA, 780 bp, Corynebacterium glutamicum
  CDS (101)..(757): RXN02530
gaggctgagctttccgtcaaacaacatcttcccaatgtggatgaaatgactgtgaccatcaccccttccaaaccttgagtcccgtgatacaattgttgatatgtcaacaaattatgaagcaatcatcattggagcaggtcaggctggactcgcggcggcgcatgaactttcccgccgcggtttcactcccggaaaagattttctcgtcctcgattccaacgacgggcccggtggcgcctggcggcataggtgggattcactcacattaggtaaagcccacggaatcgccgatctcccagggcttcccatgaatcgccccgatccgaaaactccggcttccacattggttgctggttattacggcgcttacgagaacgagttctccttcgcagttgtgcgcccagtcaaagtctcacgagttgagcccacttccgaggatccttcgagcccattgcgcgtgagcagcgacgatggtcgagagtggattacccgcatggttcttaatgcaacaggtacgtggacaaacccttatgttccgtacattcctggcatcgataaattccagggcaagcagctccacaccgttaattaccgcaaggccgaggatttcaaaggtaagaaagtcctggtcgtcggcggtggtttgagtgctgtgcaatttctgctggagttggaaggcttggcggaaaccacctgggcgacgcgtcgtccgcgaacttacgcagcgcgagttcgacgccggctggggcattgcggttgagcgcgccgtccgcgaacgca

SEQ ID NO: 402 - protein, 219 aa, Corynebacterium glutamicum
MSTNYEAIIIGAGQAGLAAAHELSRRGFTPGKDFLVLDSNDGPGGAWRHRWDSLTLGKAHGIADLPGLPMNRPDPKTPASTLVAGYYGAYENEFSFAVVRPVKVSRVEPTSEDPSSPLRVSSDDGREWITRMVLNATGTWTNPYVPYIPGIDKFQGKQLHTVNYRKAEDFKGKKVLVVGGGLSAVQFLLELEGLAETTWATRRPRTYAARVRRRLGHCG

SEQ ID NO: 403 - DNA, 990 bp, Corynebacterium glutamicum
  CDS (101)..(967): RXN00434
ccacgcgccaaaccatgcaagccatcgtccaaactgaggagaaggtcactgcttctctggaattacaggaagtccccgtcccgaccctgaagccaggtaggtgctggtgaaggtgaagcctgcgggcgttaaccgtgcggatcttttgcagacgcagggaaattatcctgtgccggcgggggcttcggagattctcgggctggaatgtgcgggtgtgatcgtgaatgccggcgacactgggcaaacagtgggtcaggaagtcgcttgccttctcactggcggtggatatgcgcaatatgtggcggttccggaaggtcagttgatgccaattccagagggttacagctttgtggaagcggcctcgatcgtggaggttgcgtgcacggtgtggtcgaatatcggcatgctggcgggcttgcagaaggaggatactttccttattcatggtggcgcgggcggtatcggaacgtttgccattcagatgggcaaggctctgggtgtgacggttgcggtgactgccggttcaactgaaaagttaaaaacctgtaagaacttaggggccgatatcctcatcaattacaaggaggaagatttcgccgaggttttgaagaacaaggcggatgtcattctcgatattattggtgcgaagtatttgtcacagaatgtgaaggcgatggccaaggacgcgcacatggtagtcatcgggatgcagggtggcgtgaaaggggagctgaatttgggtcatcttttggccaagcgaggcacgatttctgccactgcgctgcgtggtcgcgatgaggcggataaggctcggattgtcagcagcactgtcgaaaatatttggccgctgctgcaatcgaaggaaattacccctcacatcgaccacaccttgccgctagccgaagcagccgccgccttgcagaaaattcaagacggcaccatcaccggcaagctcgtgcttgcggtttaggcaagcgatgccagcaccct

SEQ ID NO: 404 - protein, 289 aa, Corynebacterium glutamicum
VLVKVKPAGVNRADLLQTQGNYPVPAGASEILGLECAGVIVNAGDTGQTVGQEVACLLTGGGYAQYVAVPEGQLMPIPEGYSFVEAASIVEVACTVWSNIGMLAGLQKEDTFLIHGGAGGIGTFAIQMGKALGVTVAVTAGSTEKLKTCKNLGADILINYKEEDFAEVLKNKADVILDIIGAKYLSQNVKAMAKDAHMVVIGMQGGVKGELNLGHLLAKRGTISATALRGRDEADKARIVSSTVENIWPLLQSKEITPHIDHTLPLAEAAAALQKIQDGTITGKLVLAV

SEQ ID NO: 405 - DNA, 1098 bp, Corynebacterium glutamicum
  CDS (101)..(1075): RXN01619
cctgcaagtttactgctcggccgtcacgggggaatggaaaaagtacgcttggtgttcatatagcgaacccattttctattgcgatgagaggaacaccaccatgcgcgcaatcactcacaacactttcggcgaccccgccgacgtcctacagattaccgagaaggaaattcccactcccggcccaggtcaggttcgtattcaagtgacgctggcaaccatccacaaccatgatttgtggaccgtgaagggctcttacggcttcgtcccagatctgccggccgccgcaggcaccgaggcagtcggcatcgtcgacgccctgggcgagggcgtcgaaggtttgcaggtcggtcagcgtgttgcgtccggcaccagctttggcatctgggcggagtacgcgcttgtcgacgcctccggcctcattcccgtaccagaacagctctccgacgaaagcgcagctcagctcgtcgcaatgcctttcagcgccatcagccttcttgatttcctggatatgaaaccaggggagtggctgatccaaaactccgcaaacggtgccgtcggccgcatgctcgcacagctggcagaatcccgcggcatccatgtcgttggtctcgtccgccgtgacgccggtgtccaagaactcgctgctcaaaacatcagcggcgtcgtttccactgagaccccaggctgggaaaagcaggtcgaagacatcaccggtggcgcaagcatcgccgtcgcacttgattccgtcggtggatcctccgcagctgacctggtgaaactgcttggcgaaggcggcaccctcgtctccttcggcgccatgggcaacccaatcatggaaatcccatccggccccgtcatcttcaagcacatcaccgtcaagggcttctggggaagcaaagtcagccgcgaaatgccagcagagaagaaaacccagttgttcggcgagctcattgcgcgcatacttgatggaacattgacccttccagttgattccacctttgatgccgctgacatcgtctcggccgtgcgcgcctccagcgagcctggccgtgccggaaaagtgctcattcgtttctaaacgtttaaggcccattagac

SEQ ID NO: 406 - protein, 325 aa, Corynebacterium glutamicum
MRAITHNTFGDPADVLQITEKEIPTPGPGQVRIQVTLATIHNHDLWTVKGSYGFVPDLPAAAGTEAVGIVDALGEGVEGLQVGQRVASGTSFGIWAEYALVDASGLIPVPEQLSDESAAQLVAMPFSAISLLDFLDMKPGEWLIQNSANGAVGRMLAQLAESRGIHVVGLVRRDAGVQELAAQNISGVVSTETPGWEKQVEDITGGASIAVALDSVGGSSAADLVKLLGEGGTLVSFGAMGNPIMEIPSGPVIFKHITVKGFWGSKVSREMPAEKKTQLFGELIARILDGTLTLPVDSTFDAADIVSAVRASSEPGRAGKVLIRF

SEQ ID NO: 407 - DNA, 1041 bp, Corynebacterium glutamicum
  CDS (101)..(1018): RXN01842
cacgtcatggtctcgcggtgatcatcttcctaccgtgacaggcaaggccgcaaacggccgtgaccacaggaaagaaattcacgaggagaggaagcacacgatgtcgaaggtatacgtgtccaacgagtacggcggcccggaaaaccaggaactgatcacccgcaacaccccccagccaggcccgggagaactcggggtcaaggtccacgcggccggggtcaacccgcttgattggaaggtccgttccggggttgccggaaccccgcgagagcttccggcacccctgggcgaggaggcctccgggatcgtcaccgccgttggagacggtgtggagggcttcgcggtcggcgatccggtgctcggcctggtggcccccggcgtcggcggatatgccgaggacaccctgctggtggcagagagtaccgtgctaaagccggaggagatctcgttcaccgacgccgccgcgatcccggtcgctggggcgagcgcctacgccggcactcaccaggtcgagcttgaaccaggccagtcgttgctgatcaatggggccggtggtggggtcgggctgatggccgcgcagatcggacgggtccacaagttccaggtcgtcggcgttgaccacgaggacaagcgcgagctcatcgaatccaccggtgctatcttcgtcgccaccggcgacgccgtcgcggagcaggtgcgtgcgctgctccctgacggtgtggacgtagtcttcgacctagtcggcggggaggcgttgcgggtggttgctcccttagcgaagaatccggcgcacgtgatctcggcggctgatgctgccaccgtgggagaactcggtggacaggtgctgcgccgcaccccggaaatggtcggacagatcaccggggtggtccagtacgggctggtcgacccgaaggtcgatacgacctacccgctggaacaggccggtaaggccctggcccacgttgagcagggccacgcccgcggcaagatcgtcctcgagctcatcacctcccaggactaaccagacaacgcggtgacctc

SEQ ID NO: 408 - protein, 306 aa, Corynebacterium glutamicum
MSKVYVSNEYGGPENQELITRNTPQPGPGELGVKVHAAGVNPLDWKVRSGVAGTPRELPAPLGEEASGIVTAVGDGVEGFAVGDPVLGLVAPGVGGYAEDTLLVAESTVLKPEEISFTDAAAIPVAGASAYAGTHQVELEPGQSLLINGAGGGVGLMAAQIGRVHKFQVVGVDHEDKRELIESTGAIFVATGDAVAEQVRALLPDGVDVVFDLVGGEALRVVAPLAKNPAHVISAADAATVGELGGQVLRRTPEMVGQITGVVQYGLVDPKVDTTYPLEQAGKALAHVEQGHARGKIVLELITSQD

SEQ ID NO: 409 - DNA, 1614 bp, Corynebacterium glutamicum
  CDS (101)..(1591): RXN00641
tgcggaattgctcgcaaatgtcacacaccgcttcaaagcaaaaacgaaaacgacatcgcggtggcaataccaacttcttttcactctcttggaggttcacatgtccacaccagtttcaaatttggcaagcgttcagaaaactctggaccatgcgcttgaggaccgccctgaagagggaatcgtccgcgtcaaccgcaacatcttcactgaccctgagatcttcgagctggagatgcgccacatcttcgaaggcatctggatggacatggctcacgagtcccagatccctaacggtggagactacttcaccacctacattggctgccagcggatcatgatcacccgttccaaggaaggcacactcaacggcctgatcaacgcgtgttctcaccgtggcgccatgctctgccgtggcaagagtgacaaccgcacctccttgacctgcccattccacggctggccattctgcaacggcggcgcactgctcaaggtcaagggcgaaaaagaaggcgcctacccagagaatttccgcaccgacggctcccacgatgtgcgtcgcgttcctaagttagagtcctaccgtggcttcctcttcggctccctcaacgatgatgtcgtttctttggaagagcacctcggcgacacccgtaccgtcattgacatgctggttgaccaatccccagaaggcctcgaagtactgcgcggatcctccacctacacctacgacggcaactggaagctccagaccgaaaacggtgcagacggctaccacgtttcctccacccactggaactacgctgcaaccacctcccgccgtggcactggtgaatccgcgaacgaaaccaaggcaatggacgctggtacctggggcaagcagggtggcggatacttctcctacccttacggccacatgctgctgtggatgtggtggggcaacccagaagaccgcccactgttcgagcgccgcgacgagttcaagaaggaattcggcgaagaaaagggcgagttcatggttggtgcttcccgcaatctgtgcctctaccccaatgtttacctgatggatcagttctcctcacagatccgccacatccgcccaatctcagttgatcagaccgaagtcaccatctactgcatcgcacctaagggcgagtccgcggaagcacgtgcaaaccgcatccgccagtacgaagacttcttcaacgcaacgggcatggcaaccccagatgacctggaggaattccgctcctgccagaagacctaccaggcatctgccttcccatggaatgacatgacccgcggtttgggccaccaggtacagggaccaaacgaggttgccaagggcctaggcatgaacgaagttctttcctccggagcacgcaccgaagatgaaggcctctacccaatccagcacggcttctggcatgaactcatgcaggaggctgtgaataagcagagcatcaaggaaaaggaattggctgacgataccgcttcttcccttgccaccgtagctgcagccaaaatccgtgaggaagcaaaggcagccgcgaagtccgacgctggagagcctcgccgccgtcgtcgcacccgcggttagtcgtcgaaaagcaaaaaatc

SEQ ID NO: 410 - protein, 497 aa, Corynebacterium glutamicum
MSTPVSNLASVQKTLDHALEDRPEEGIVRVNRNIFTDPEIFELEMRHIFEGIWMDMAHESQIPNGGDYFTTYIGCQRIMITRSKEGTLNGLINACSHRGAMLCRGKSDNRTSLTCPFHGWPFCNGGALLKVKGEKEGAYPENFRTDGSHDVRRVPKLESYRGFLFGSLNDDVVSLEEHLGDTRTVIDMLVDQSPEGLEVLRGSSTYTYDGNWKLQTENGADGYHVSSTHWNYAATTSRRGTGESANETKAMDAGTWGKQGGGYFSYPYGHMLLWMWWGNPEDRPLFERRDEFKKEFGEEKGEFMVGASRNLCLYPNVYLMDQFSSQIRHIRPISVDQTEVTIYCIAPKGESAEARANRIRQYEDFFNATGMATPDDLEEFRSCQKTYQASAFPWNDMTRGLGHQVQGPNEVAKGLGMNEVLSSGARTEDEGLYPIQHGFWHELMQEAVNKQSIKEKELADDTASSLATVAAAKIREEAKAAAKSDAGEPRRRRRTRG

SEQ ID NO: 411 - DNA, 1166 bp, Corynebacterium glutamicum
  CDS (16)..(1143): RXN01993
ctttaggagttcaccatgacactgtccgaacgcaagctcaccaccaccgccaagattcttccccacccactcaacgcctggtacgtcgccgcttgggattatgaagtcacatctaaaaagcccatggccaggacaatcgccaacaaaccactcgctttgtaccgcaccaaagatggccgagccgttgcccttgcagacgcctgctggcaccgcctcgcaccgctatccaagggaaaactcgtgggcacagacggaatccaatgcccttatcacggcttggagtacaactccgcgggccgctgcatgaaaatgcccgcgcaggaaaccctcaacccgtcagcagccgtcaactcctaccccgtggtggaagcccaccgctttgtgtgggtgtggctgggcgatcccacattggcagatcccacccaagtacccgatatgcaccagatgagccaccccgaatgggcaggcgatggacgcaccatctccgctgactgcaactaccaattagtgctggacaacttgatggacctcacccacgaagagttcgtgcactcctccagcatcggacaagacgaacttagtgaatcagagttcgtggtcacccacactgaagattccgtgacggtcacccgctggatgcatgacatagatgcaccaccgttttggcaaaagaacatgaatgataagttcccaggatttgaaggcaaggtggatcgttggcagatcatccactactactacccttccaccatctgcattgatgttggtgtagcaaaggctggaactggcgcgcaggaaggcgaccgcagccagggcgttaatgggtatgtcatgaacaccattaccccagattcagatcgttcctctcattacttctgggcattcatgcgcaactaccgcctggaaagccaaaccatcaccacccagctgcgcgacggtgtatccggtgtattcaaagaagacgaagacatgctgaccgctcagcaagatgccatcgacgccaacaccgactacgagttttacagcctcaacattgatgccggtggcatgtgggtgcgccgaatcctcgaggaagcactctccaaggaaggccgactggatatccccaccacattcccccgcgcaacaccgaagccggaggcataaaccatgaactcgcaatggca

SEQ ID NO: 412 - protein, 376 aa, Corynebacterium glutamicum
MTLSERKLTTTAKILPHPLNAWYVAAWDYEVTSKKPMARTIANKPLALYRTKDGRAVALADACWHRLAPLSKGKLVGTDGIQCPYHGLEYNSAGRCMKMPAQETLNPSAAVNSYPVVEAHRFVWVWLGDPTLADPTQVPDMHQMSHPEWAGDGRTISADCNYQLVLDNLMDLTHEEFVHSSSIGQDELSESEFVVTHTEDSVTVTRWMHDIDAPPFWQKNMNDKFPGFEGKVDRWQIIHYYYPSTICIDVGVAKAGTGAQEGDRSQGVNGYVMNTITPDSDRSSHYFWAFMRNYRLESQTITTQLRDGVSGVFKEDEDMLTAQQDAIDANTDYEFYSLNIDAGGMWVRRILEEALSKEGRLDIPTTFPRATPKPEA

SEQ ID NO: 413 - DNA, 816 bp, Corynebacterium glutamicum
  CDS (101)..(793): RXN00658
cattgacacccacaggtttaccagcatcacggaaagtttggatggatttttactccggccacaacgtctggctggaagctcagccacgtgctttctggtcgtgcgccacgacgagcactacccagctgcggcaaacctcattgctttcgataagggatggtccaccctcatcgcccctcagctggaagatccagaggcggaggagttcaccgccggattcctcaccgaataccaggacaatctgatcactgcgggcatggagcaccaggcgctcgcgagcggcttcccggtggggcgtcgcttcaagtccgatattgctttacgacgctgcgatgcggtgaccacccacatcggccacgaacactccgccgatggtcactggaggatctacgtattcgctggccaagccaccccacaagattccgagtctgcactgaacaagtgggcgcagtggatggaggaaagcgaagactcaccactcaaccgcttcaccccagaagccggcgaccgcaacgcagtcttcgatatcaaggctacctaccagcagcattaccactccttcgacctgttcgatgcgccagaggtcttcttcccacgagttggaccatacaagctgcaaaacctcgaaaacgtttggaccgcactggattcccaagacatctttgagtcccgtggcatcagtcgcgatggcgcaattgttgtcgttcgcccagaccagtacgtcgcagcagtcctcccactcgaagacaccgcagcactggctgagttcttcaatggcaatctgcttgagccataaaccctaaattctaggaacga

SEQ ID NO: 414 - protein, 231 aa, Corynebacterium glutamicum
VRHDEHYPAAANLIAFDKGWSTLIAPQLEDPEAEEFTAGFLTEYQDNLITAGMEHQALASGFPVGRRFKSDIALRRCDAVTTHIGHEHSADGHWRIYVFAGQATPQDSESALNKWAQWMEESEDSPLNRFTPEAGDRNAVFDIKATYQQHYHSFDLFDAPEVFFPRVGPYKLQNLENVWTALDSQDIFESRGISRDGAIVVVRPDQYVAAVLPLEDTAALAEFFNGNLLEP

SEQ ID NO: 415 - DNA, 1008 bp, Corynebacterium glutamicum
  CDS (101)..(985): RXN00178
gcgaataatccacggacggtcacagaagaaaacctcactgcgctgcttaccacagcgctcaacggcgacgatccagcaactttgaattaaggagaccaacatgactatttcagcacaacagcaagcagtggaagaagaccttgtagagcgcgtactcgcatcttttgattcgtgtgaaaaccctcgcctcaaactagtgatgaaatccctgactgtgcatctccatgatttcatccgcgatgttcgactcactgaagaagagtggaactacgccattgatttcctcaccaaggttgggcatatcaccgacgataagcgccaagaattcgtgttgctctctgacaccttgggtgcatccatgcagaccatcgctgttaataacgaagcatatgaagacgctaccgaagcaacagtctttggccccttctttgtcgatgatgcgccactggtccaaaacggagatgacattgcctttggcgcagtcggccagccggcatgggtggagggaacggtcaaagacactgaaggaaaccccattcccaatgcacgcattgaagtatgggaatgcgatgaagatggactttatgatgtgcaatacgccgatgagcgcagtgctggacgcgcacacctgtattcagatgaaaacggcgaataccacttctggggactaactcccgtgccatatcccatcccacacgatggtccagtaggacaaatgctccaagcagttggtcgttcccccgttcgttgcgcgcacctacacttcatggtgactgcgccagagaagcgaaccttggtaacccatatcttcgttgagggcgatccgcagctagagatcggcgattccgtgtttggcgtgaaggactcactgattaagaaattcgttgagcaacctgcaggaaccgcaactccagatggtcgcgatgtgggtgatcaaacctgggcacgcacacgttttgatattgtgctcgcccccggcaatgtctaagtagaagcagcaaaaaacca

SEQ ID NO: 416 - protein, 295 aa, Corynebacterium glutamicum
MTISAQQQAVEEDLVERVLASFDSCENPRLKLVMKSLTVHLHDFIRDVRLTEEEWNYAIDFLTKVGHITDDKRQEFVLLSDTLGASMQTIAVNNEAYEDATEATVFGPFFVDDAPLVQNGDDIAFGAVGQPAWVEGTVKDTEGNPIPNARIEVWECDEDGLYDVQYADERSAGRAHLYSDENGEYHFWGLTPVPYPIPHDGPVGQMLQAVGRSPVRCAHLHFMVTAPEKRTLVTHIFVEGDPQLEIGDSVFGVKDSLIKKFVEQPAGTATPDGRDVGDQTWARTRFDIVLAPGNV

SEQ ID NO: 417 - DNA, 735 bp, Corynebacterium glutamicum
  CDS (101)..(712): RXN01461
tcgactatgacgagacccgtgaaaacttcgcgcttggttacaagttcgacatcgtccttcgtggccgcaacgccaccccatttgagtaaagggttttgcaatgattgatacagggaagaacggcgagttccgctacgagcagtcgaatatcatcgatcagaacgaagccgagttcggcatcactccttcacagaccgtgggcccttacgtccacatcggtttgacccttgaaggtgcggagcatctcgtggagccaggttcggaaggcgcggtgtcctttactgtttccgcaactgatggcaacggcgaccccatcgcggatgccatgtttgaactgtggcaggccgatccagagggcatccacaactctgatttggatccaaaccgcacagcaccagcaaccgcagatggcttccgcgggcttggtcgcgcgatggcaaacgcgcagggtgaggcaacgttcaccactttggttccgggagcattcgcagatgaggcaccacacttcaaggttggtgtgttcgcccgtggcatgctggagcgtctgtacactcgcgcatacctgccagacgccgatttgagcaccgacccagttttggctgtggtcccagctgatcgacgtgacctcctggtggctcaaaagaccgatgatggattccgcttcgacatcactgtccaggctgaagacaatgaaaccccattttttggactctaaattgacccgatctttatact

SEQ ID NO: 418 - protein, 204 aa, Corynebacterium glutamicum
MIDTGKNGEFRYEQSNIIDQNEAEFGITPSQTVGPYVHIGLTLEGAEHLVEPGSEGAVSFTVSATDGNGDPIADAMFELWQADPEGIHNSDLDPNRTAPATADGFRGLGRAMANAQGEATFTTLVPGAFADEAPHFKVGVFARGMLERLYTRAYLPDADLSTDPVLAVVPADRRDLLVAQKTDDGFRFDITVQAEDNETPFFGL

SEQ ID NO: 419 - DNA, 1584 bp, Corynebacterium glutamicum
  CDS (101)..(1561): RXN01653
ttcattcagggtgaatgctctccttgtttcagatgttcaacgctccataaagtagaccgcaatctagacaaagatgtctattttaattaaggagcagaacatggccacggccgagaacacaacacaggagaatcggaaaatcctgttcaacgcatttgatatgaactgcgttgcgcatcagtccccaggactgtggacacacccgaaggataaggcgcgagactacaacactcttgattactgggtgcaccttgccaagactttggagaagggccttttcgacggccttttcatcgcagatgtgcttggaacttacgatgtttatggttctagtaatgaagcggcgttgagcagtggtgcgcaggtgcctgtcaatgatccgatccttcttgtttctgcgatggcctatgccacaaagaacctcgggtttggcattactgcaggtactgcctatgagcacccgtatccttttgcgcggcgtctggccacacttgatcacctgactaatgggcgtgtggggtggaatgtggttactggctatcttccctctgctgctcaaaacatgggtgacaccgatcagctgccacatgatgagcgctatgacaaagcagatgaatacctggaagtgatctacaagcttctcgagggctcctgggaagacgatgctgttcaaaacaatacggagacgagtgtctttacggactcctccaaagtgcacgccattaatcatcatggcaagtactttgatgtgccgggcattgccatcactgagccgagtgtgcagcgtacgccggtgatctaccaggcgggtgcatcgccgcgcggattgaaattcgctggtgagaatgcagaagcagtgtttatcaattccagcaccgtggaggcaatcaccaagactgtcgcaaaaattcgcgctgctgcggtcgctgcgggacgtgatccacatgcggtgaagatctttgcgatgcaaaccatcatcactggtgaaacagaagcagatgcgcaggcaaagctggaggaatacagtcgctatatcgatcctgtcggtggtctgaccttgatgtctggatggaccggcgcggatctgtcgcagtatgacctggatgaaccgatcaccaatattgagtcaaacgctattcagtccactgcagccaccattagcaacggcaccggtgaaggtgcgtggacggtacgcaaactgggtgaggcaaccggcatcggcggcttcggaccagtgcttgtgggatctggcgctaacgttgccgcggaacttgcacgcatccaggatctcagcgatgttgatggtttcaaccttgcttatgccatcaccccaggaacttttgaagatgtcgtggactttgtggtgcctgagctgcaaaaacttagccgctacaagacggaatacgcgccgggttccttgcgcaacaaattgctcggtaaaggtgatcgcctggacgatacccaccgcggcgcaagctaccgcctaggcgctcggaactccaccgccactattgatctcagttccatatccgcccaactagtttcccagggagcccactcatgatctcaccgcaaacaatcatc

SEQ ID NO: 420 - protein, 487 aa, Corynebacterium glutamicum
MATAENTTQENRKILFNAFDMNCVAHQSPGLWTHPKDKARDYNTLDYWVHLAKTLEKGLFDGLFIADVLGTYDVYGSSNEAALSSGAQVPVNDPILLVSAMAYATKNLGFGITAGTAYEHPYPFARRLATLDHLTNGRVGWNVVTGYLPSAAQNMGDTDQLPHDERYDKADEYLEVIYKLLEGSWEDDAVQNNTETSVFTDSSKVHAINHHGKYFDVPGIAITEPSVQRTPVIYQAGASPRGLKFAGENAEAVFINSSTVEAITKTVAKIRAAAVAAGRDPHAVKIFAMQTIITGETEADAQAKLEEYSRYIDPVGGLTLMSGWTGADLSQYDLDEPITNIESNAIQSTAATISNGTGEGAWTVRKLGEATGIGGFGPVLVGSGANVAAELARIQDLSDVDGFNLAYAITPGTFEDVVDFVVPELQKLSRYKTEYAPGSLRNKLLGKGDRLDDTHRGASYRLGARNSTATIDLSSISAQLVSQGAHS

SEQ ID NO: 421 - DNA, 702 bp, Corynebacterium glutamicum
  CDS (101)..(679): RXN02053
aaccagccagaaactatctccaaaagctaataaaacccttgcactgacaaataaggcgacctaccatgactctgtttccaacacataaaaaggataaaaaatgtcactttcagtcgtcgaggcgattaccaaccgccgcgccacccgcaaatacaccgatgaagctcctacccctgagctgatcgacaaaatcgttgaccttgccctggaggcacccagtgcgttcaatgcgcagcaacgtgaaattgttgtgattactgatcccgcacagaagcagaagctttacgaggcctcccatcagaaacaattcctcaccgcacctgtaactttcattgcggttgcccgcgtggaaaacgagcctgaggatttggaagagattcttggtacggaaagggctgaacgtgtcgcgggattcatcaacggtcgcagcattcagcaggcacgcgaagcaacgttgagggatgccagcctcgcggcggcttttctaattctggctgcccaggcggagggtttgagtaccagcccgactactggttgggatgaggaaaaagtgaaggaagcaatcggtctcggcgggcgtgaggatcgtgcaatcgcccttgttattgctaccggattccctaatgaacagccggagcaccctggtcgtttgcagaataggcgcatcgacaacagctactaactctgccagctcgcccggac

SEQ ID NO: 422 - protein, 193 aa, Corynebacterium glutamicum
MSLSVVEAITNRRATRKYTDEAPTPELIDKIVDLALEAPSAFNAQQREIVVITDPAQKQKLYEASHQKQFLTAPVTFIAVARVENEPEDLEEILGTERAERVAGFINGRSIQQAREATLRDASLAAAFLILAAQAEGLSTSPTTGWDEEKVKEAIGLGGREDRAIALVIATGFPNEQPEHPGRLQNRRIDNSY

SEQ ID NO: 423 - DNA, 1191 bp, Corynebacterium glutamicum
  CDS (101)..(1168): RXN00177
ctattccacagcagtggacgctgaacaacttcaaacacagattaagcagctatcggatctacttcacctcaactcagttgtcggagcataggagctaaaaatgtctttacagttcgatcatgaaaccctcggtcaacgagttctgttcggttcaggtgaggcggcgcaaaatctcgccgctgaaattagccgactcgatgccaaaaacgtcatggtggttgccggtgatttcgagcttcccatggcacggcaagtagcagcagatattgatgtcaaggtgtggcattcaaatgtcgtgatgcatgtgcccatcgaaacagcagaagaagcacgcagtgttgcgaaagaaaacgacattgatgttgtggtgtgtgtgggcggtggatccacaacaggtctagctaaagcgattgccatgaccaccgcattgccgatcattgcggtacccactacttatgcaggttctgaagcaacaaatgtgtggggattgaccgaagccgcgcgcaaaacaactggtgttgataacaaagtgctgccagtgacagttatctacgattcagcgttaaccatgtctttgccggtagaaatgtcggttgcttctggtctcaatggtttggctcactgcattgattctttgtggggaccgaaggcggatcccatcaatgcggctatggctgctgagggaattcgagcactttctgctggccttcccaagattgtggcagatgctcaggacgtagatggtcgcgatgaagcgctctacggtgcctacctggctgcggtgtcttttgcctctgctggctctggtctccaccacaagatctgccacgtgttgggtggaacttttaaccttccacacgcgcaaacccatgcaacagtactgccttatgttcttgccttcaacgcgccatatgcgccacaggcagaacaacgcgcagcggcagctttcggttctgcgacagcacttgaaggattgcaacagctgcgtgcccaagtgggagcaccacagcgactatccgattacggattcaccgcagcaggaatcccagaggcagtggaaatcatcttggagaaagtaccggcgaataatccacggacggtcacagaagaaaacctcactgcgctgcttaccacagcgctcaacggcgacgatccagcaactttgaattaaggagaccaacatgactattt

SEQ ID NO: 424 - protein, 356 aa, Corynebacterium glutamicum
MSLQFDHETLGQRVLFGSGEAAQNLAAEISRLDAKNVMVVAGDFELPMARQVAADIDVKVWHSNVVMHVPIETAEEARSVAKENDIDVVVCVGGGSTTGLAKAIAMTTALPIIAVPTTYAGSEATNVWGLTEAARKTTGVDNKVLPVTVIYDSALTMSLPVEMSVASGLNGLAHCIDSLWGPKADPINAAMAAEGIRALSAGLPKIVADAQDVDGRDEALYGAYLAAVSFASAGSGLHHKICHVLGGTFNLPHAQTHATVLPYVLAFNAPYAPQAEQRAAAAFGSATALEGLQQLRAQVGAPQRLSDYGFTAAGIPEAVEIILEKVPANNPRTVTEENLTALLTTALNGDDPATLN

SEQ ID NO: 425 - DNA, 960 bp, Corynebacterium glutamicum
  CDS (101)..(937): RXC00963
ctggctctgacggcgtcgacttgttctgcttctctgatacaccaattttcgaggcccttaacctcgcacgtacttttactccggaaggaatctagaacttatgcgtcttgcaacaatccgcaccaacggcaccaccattgctgctcgtgttgaatctgaaaacaccgctaccaccatcgagggctttgccaacgtcggtgaattactccaggaatccaactggcgcgagctggcagaaaacgctgctggtgaggctgtgacctttgaaaacaaggagctagatgcagtagttccagcacctaagaagattgtgtgcgtcggccttaactacgccaaccacattaaagaaatgggccgcgacctccctgataccccaaccctttttgttaagttccctgacgcgctcatcggacctttcgatgatgttgtcgttccagagtgggctaacaaggctctcgactgggaaggcgagatggcagttatcattggcaagcgcgcacgccgtgtcaagcaggccgatgctgctgagtacatcgctggctacgcagtgatgaacgattacaccacccgcgatttccagtacgcagcacctgcaaagactccacagtggcaccagggcaagtctttggaaaagtccgctggcttcgggccttggatgactaccccagattcttttgagttcggcggcgagctggcaacctacctcgagggcgagaaggtacagtccacccctaccaatgacctggtctttagcccagaaaagctcatcgaatacatcacccacatctacccattggatgctggcgacgtcattgtcaccggtaccccaggcggcgttggccacgcacgtaacccacagcgctacatcggtgacggcgaaaccgtaaaggttgagattgcgggcctcggcttcattgaaaacaagacggtgtttgaataaatgacaactttccacgatct

SEQ ID NO: 426 - protein, 279 aa, Corynebacterium glutamicum
MRLATIRTNGTTIAARVESENTATTIEGFANVGELLQESNWRELAENAAGEAVTFENKELDAVVPAPKKIVCVGLNYANHIKEMGRDLPDTPTLFVKFPDALIGPFDDVVVPEWANKALDWEGEMAVIIGKRARRVKQADAAEYIAGYAVMNDYTTRDFQYAAPAKTPQWHQGKSLEKSAGFGPWMTTPDSFEFGGELATYLEGEKVQSTPTNDLVFSPEKLIEYITHIYPLDAGDVIVTGTPGGVGHARNPQRYIGDGETVKVEIAGLGFIENKTVFE

SEQ ID NO: 427 - DNA, 1101 bp, Corynebacterium glutamicum
  CDS (101)..(1078): RXN00299
tgccatcggtttggctattgattggaacaagaaaggtgcccagtctgttgcaaagaaggaatccatttccgtctaatcgctaattgcgaggagtctttgcatgtctatcccactttcactgattgattttgccaccatttttgagggcgaaaggcctggtgacagcttcaaacgatcagtggcattggcgcaaaaagctgaaggtttaggcttcaagcgcatttggtacgcagagcatcacaacatggagagcatttcttcagctgctcctgcagtgcttatttctcacatcggtgcgaacaccaagactattcgtctgggtgccggcggcgtcatgctgcccaaccactccccatatgtcatcgctgagcagttcggcaccttggcggagttgtacccagaccgcatcgacctcggcctgggccgtgcccctggcacggacatgaataccttgcgcgctttacgacgcgaccctcagtccgccgagaacttcccgtccgacgttgtcgagctgaactcttacctcaccggccgttcccgtctcccaggggttaacgcaattccaggcaagggcaccaacgtaccgctgtacatcttgggttcatccctctttggtgcacaattggcagcacagttgggtatgccttattccttcgcatcccacttcgcaccaactcaccttgagcacgcggtgcaaacctaccgggataactaccagccttcagagcagcatcctgagccttatgtcattgcggccgtcaatgtcaccgcatctgattccactgaacaagcccacgatgatttctacaaggtagcgcgtgcacgcgtgaagaacatggcattgcgtggccgacaagttactgatgagcaacttgatgaactcatggattcaccagctgctcgccaaattgtcgacatgcttcactacaccgctataggcactggatccgaagttaaagaatacctagacggttttgtaaagacggcacaggctgatgaactgatgatctccctgcaatcccccaacactgaagcaaccacgcgcaatatggaaattcttgcggatgcgtggattaattagtaccgatgggccggtagaca

SEQ ID NO: 428 - protein, 326 aa, Corynebacterium glutamicum
MSIPLSLIDFATIFEGERPGDSFKRSVALAQKAEGLGFKRIWYAEHHNMESISSAAPAVLISHIGANTKTIRLGAGGVMLPNHSPYVIAEQFGTLAELYPDRIDLGLGRAPGTDMNTLRALRRDPQSAENFPSDVVELNSYLTGRSRLPGVNAIPGKGTNVPLYILGSSLFGAQLAAQLGMPYSFASHFAPTHLEHAVQTYRDNYQPSEQHPEPYVIAAVNVTASDSTEQAHDDFYKVARARVKNMALRGRQVTDEQLDELMDSPAARQIVDMLHYTAIGTGSEVKEYLDGFVKTAQADELMISLQSPNTEATTRNMEILADAWIN

SEQ ID NO: 429 - DNA, 784 bp, Corynebacterium glutamicum
  CDS (18)..(761): FRXA00299
gggtgccggcggcggtcatgctgcccaaccactccccatatgtcatcgctgagcagttcggcaccttggcggagttgtacccagaccgcatcgacctcggcatgggccgtgcccctggcacggacatgaataccttgcgcgctttacgacgcgaccctcagtccgccgagaacttcccgtccgacgttgtcgagctgaactcttacctcaccggccgttcccgtctcccaggggttaacgcaattccaggcaagggcaccaacgtaccgctgtacatcttgggttcatccctctttggtgcacaattggcagcacagttgggtatgccttattccttcgcatcccacttcgcaccaactcaccttgagcacgcggtgcaaacctaccgggataactaccagccttcagagcagcatcctgagccttatgtcattgcggccgtcaatgtcaccgcatctgattccactgaacaagcccacgatgatttctacaaggtagcgcgtgcacgcgtgaagaacatggcattgcgtggccgacaagttactgatgagcaacttgatgaactcatggattcaccagctgctcgccaaattgtcgacatgcttcactacaccgctataggcactggatccgaagttaaagaatacctagacggttttgtaaagacggcacaggctgatgaactgatgatctccctgcaatcccccaacactgaagcaaccacgcgcaatatggaaattcttgcggatgcgtggattaattagtaccgatgggccggtagaca

SEQ ID NO: 430 - protein, 248 aa, Corynebacterium glutamicum
MLPNHSPYVIAEQFGTLAELYPDRIDLGMGRAPGTDMNTLRALRRDPQSAENFPSDVVELNSYLTGRSRLPGVNAIPGKGTNVPLYILGSSLFGAQLAAQLGMPYSFASHFAPTHLEHAVQTYRDNYQPSEQHPEPYVIAAVNVTASDSTEQAHDDFYKVARARVKNMALRGRQVTDEQLDELMDSPAARQIVDMLHYTAIGTGSEVKEYLDGFVKTAQADELMISLQSPNTEATTRNMEILADAWIN

SEQ ID NO: 431 - DNA, 825 bp, Corynebacterium glutamicum
  CDS (101)..(802): RXA00332
aatgaactctggaaccgccatgcagcaaaacctctccaattggtaatctttgactcccaggttacgccagccctgcgacaccaccatctagggttagagtatggccttcaacaaagcgtacgatgcacttcgcgcccctcaaatcaccctcggactcatgacaccaaacggccctgaactagggcgcagtgaaatggttccaaccgaaaatagcatcgaactagccatacaagcagaagctcaaggattcagaggcatgtgggttcgagacgttccactcgcagttcctcaaggaatcactgttaccgataaacaggctacgtatttagatgatccattcttaatgctcggtgcgatggcctctgtgacctctacaatcgcgctgggcactgcagcgaccgtgcttccactcagacatccgctacatgtggcgaaatccgcgctcacccttgatcgactcagccacggacgtttcgttttaggcatcggctctggcgacaggcctgaagaattcgagatttttggcaaaagcttagacaatcgacgcgctgatattcagtctgggtgggcaattttgcgtgcagctttgtcgccggatcctgcgatgcgggccgaccttgaatttgcgccaaccacgccacctgaagctcagatccccatgatcgctgtaggttctgcccgacaaacagtgcaatggatcgcccgaaacgccgacggatgggcaacctactaccgccccgctgaagctcaagtcggacgcctcgatctctgggacaaagcccgtggtggcacccgcccttgttgatttcctccatggggctcaac

SEQ ID NO: 432 - protein, 234 aa, Corynebacterium glutamicum
MAFNKAYDALRAPQITLGLMTPNGPELGRSEMVPTENSIELAIQAEAQGFRGMWVRDVPLAVPQGITVTDKQATYLDDPFLMLGAMASVTSTIALGTAATVLPLRHPLHVAKSALTLDRLSHGRFVLGIGSGDRPEEFEIFGKSLDNRRADIQSGWAILRAALSPDPAMRADLEFAPTTPPEAQIPMIAVGSARQTVQWIARNADGWATYYRPAEAQVGRLDLWDKARGGTRPC

SEQ ID NO: 433 - DNA, 842 bp, Corynebacterium glutamicum
  CDS (1)..(819): RXA01838
cagcacctctccggcggccgtgttgaccttatgatgggccgtggcaacaccggacccgtttacccatggtttggcaaagacatccaccaaggcatcccactagcgattgaaaactaccacctcctgcgccgcctctggcgcgaagacgtagtcaactggcagggcaaattccgcacaccgttgcagggatacacctctaccccagcaccattagacggcgttgcaccattcgtctggcacggctccatccgctccaccgaaatcgcagagcaagcagccttctatggcgacggcttcttccacaacaacatcttctggaacaaagagcacaccgcccaaatggtcaacctctaccgccagcgtttcgaacactacggacacggccaagcagaccaggccatcgtgggactcggtggccaagtcttcatcggcgattctgaagaagaagcaaagaagaccttccgcccctacttcgacaacgcccctgtctacggacacggaccatcacttgaagatttctcccgcctgaccccactaaccgtcggtaccgctgagcaagttatcgaacgcaccatggaattcgccgactgggtaggcgattaccagcgccagctcttcctcatcgaccacgccggcctgccactagaaatggtccttgatcagatcgaacgcctcggccacgatgtcgtcccagaggtacgccgccgcatggaggagcgtcgcccagaccacgttccctccaacccaccaacccaccagagcctgaaggccaaccgaaacagcccttactttcagatcaaccctggtcagccaactgagtagtttttctgaaactaaggaga

SEQ ID NO: 434 - protein, 273 aa, Corynebacterium glutamicum
QHLSGGRVDLMMGRGNTGPVYPWFGKDIHQGIPLAIENYHLLRRLWREDVVNWQGKFRTPLQGYTSTPAPLDGVAPFVWHGSIRSTEIAEQAAFYGDGFFHNNIFWNKEHTAQMVNLYRQRFEHYGHGQADQAIVGLGGQVFIGDSEEEAKKTFRPYFDNAPVYGHGPSLEDFSRLTPLTVGTAEQVIERTMEFADWVGDYQRQLFLIDHAGLPLEMVLDQIERLGHDVVPEVRRRMEERRPDHVPSNPPTHQSLKANRNSPYFQINPGQPTE

SEQ ID NO: 435 - DNA, 1167 bp, Corynebacterium glutamicum
  CDS (101)..(1144): RXA02643
tgagaacacctaaaaaccttgcgggaataccaccaaccccatattgttgatatatctacaaactcttttaataagtctgatcaacaacgtgaggaaagcaatgaaaaacgtctccttcggcctcgacaccttcggcgacaacgccatcgacctgcagggcaacccggtctcccctgcacaaacacttcgaaacatcattgatgaagccaagatggcagacaaagtcggggtggatatcatcggcatcggagagcaccaccgtgaggaatactcagtttctgcacctgacatcgtcatgacagctatcctcgcatccactgagcgactcaaagtcacctcttccgtgactgtgctgtcctctgatgatcctgttcgcctgtttgagcgttattccaccatgaatgcactgtccaacggtcgcgccgaaatcaccttgggacgcggttccttcattgagtctttcccattgtttggttttgatcttcaggactacgagcagctgtttagtgaacgccttgatttgttcgcgaagattcttgaggccgacagccgtggtcagggcgtgacctggcatggtgagacccgctcggcgttggaaaaccagatgctttacccaccaactgagaatggcattcacgcttgggttgcagtgggtggcagcccagaatcagtcgtgcgcgctgctaagtatcgtttcccgttgatgcttgccatcatcggcggtgctcctgagcgtttccgcccgtatgtggatctgtacaagcgtgccaacgaacagttcgggcagcctcaaaagcccattggtgtgcactcccctggactcattgcggcaactgatgaggaagcccgtgagctagcacttaatgattggttggaactccaacgcaagatcggtgctgaacgcggttgggctcctgcggatgcaatgcagtttgaacgcgaaatcgatcacggttccttatacatcggttcccctgagacggtcgcaaagaagatcgccaaaaccatttcagtgcttgatcttgatcgctttaccctcaaatacgccagtggccagacccctcatgagtacttgctgaagtccattgagttgtatggcactgaggttattccgctggtgaaggacatcttgaccaagcaggcttaagaaggtcttaggacattccc

SEQ ID NO: 436 - protein, 348 aa, Corynebacterium glutamicum
MKNVSFGLDTFGDNAIDLQGNPVSPAQTLRNIIDEAKMADKVGVDIIGIGEHHREEYSVSAPDIVMTAILASTERLKVTSSVTVLSSDDPVRLFERYSTMNALSNGRAEITLGRGSFIESFPLFGFDLQDYEQLFSERLDLFAKILEADSRGQGVTWHGETRSALENQMLYPPTENGIHAWVAVGGSPESVVRAAKYRFPLMLAIIGGAPERFRPYVDLYKRANEQFGQPQKPIGVHSPGLIAATDEEARELALNDWLELQRKIGAERGWAPADAMQFEREIDHGSLYIGSPETVAKKIAKTISVLDLDRFTLKYASGQTPHEYLLKSIELYGTEVIPLVKDILTKQA

SEQ ID NO: 437 - DNA, 726 bp, Corynebacterium glutamicum
  CDS (101)..(703): RXA01933
ctagaagccttaggcaagaaatttggttgagttttcgatctctacgacgcgtcatctcaattccacctaggcttggatgcaggttagaaaggagccttcgatgtctaagactcgtacttttctgtttgatctttatggtgttctcatcaaggagcatggtgcggcgcagtttgagcgggttgcgcgtgcggtgggggagccgtccaagaacgacaagctgcatgaggtttatgagtcgcttcgtctggatctggatgccggccgcgtgagtgaggtgaattattggaatcagatcaaactattggtgggtttggagtttttggatatccaggaggtcatcgcggctgactacaggggcctttatgagcgtgatcaggacatggttgattatgtgttgtcgttgaaggcgaaaggccaccgcatcggaattttgtcgaatattccggaggggttggccaagctgttgaaggagcacaattcggagtggcttgatcagcttgatgcggtgactttgtcgtgcgatattggcgcggcgaagccggagccgaagtctttccatgtggcacttgaggcccttggtgaaaaagctgaggatgtgacctttattgatgatcgcgtgcgtaacattgaggcagcgcgcgaagaaggtctcagcacaattcacttcactggcttagattccttaaaagaaagcattcaggaatgacacctcaaccactgattttg

SEQ ID NO: 438 - protein, 201 aa, Corynebacterium glutamicum
MSKTRTFLFDLYGVLIKEHGAAQFERVARAVGEPSKNDKLHEVYESLRLDLDAGRVSEVNYWNQIKLLVGLEFLDIQEVIAADYRGLYERDQDMVDYVLSLKAKGHRIGILSNIPEGLAKLLKEHNSEWLDQLDAVTLSCDIGAAKPEPKSFHVALEALGEKAEDVTFIDDRVRNIEAAREEGLSTIHFTGLDSLKESIQE

SEQ ID NO: 439 - DNA, 1039 bp, Corynebacterium glutamicum; identical to SEQ ID NO: 189
  CDS (101)..(1039): RXA02351

SEQ ID NO: 440 - protein, 313 aa, Corynebacterium glutamicum; identical to SEQ ID NO: 190

SEQ ID NO: 441 - DNA, 18 bp, Artificial Sequence
  Description of Artificial Sequence: primer
ggaaacagtatgaccatg

SEQ ID NO: 442 - DNA, 17 bp, Artificial Sequence
  Description of Artificial Sequence: primer
gtaaaacgacggccagt

What is claimed is:

1. An isolated nucleic acid molecule comprising the nucleotide sequence of SEQ ID NO:1, or the full complement thereof.

2. An isolated nucleic acid molecule which encodes a polypeptide comprising the amino acid sequence of SEQ ID NO:2.

3. An isolated nucleic acid molecule which encodes a polypeptide comprising the amino acid sequence of SEQ ID NO:2, wherein the nucleic acid molecule hybridizes to the complement of a nucleic acid molecule consisting of SEQ ID NO:1 in 6×SSC at 45° C., followed by one or more washes in 0.2×SSC, 0.1% SDS at 50–65° C., and wherein said nucleic acid molecule encodes a sulfate adenylate transferase subunit 2.

4. An isolated nucleic acid molecule comprising a nucleotide sequence which is at least 90% identical to the nucleotide sequence of SEQ ID NO:1, and wherein said nucleic acid molecule encodes a sulfate adenylate transferase subunit 2 polypeptide, or the complement thereof.

5. An isolated nucleic acid molecule comprising a fragment of at least 15 contiguous nucleotides of a nucleic acid molecule comprising the nucleotide sequence of SEQ ID NO:1.

6. An isolated nucleic acid molecule which hybridizes to the nucleic acid molecule of any one of claims 1–5 at 6×SSC at 45° C., followed by one or more washes in 0.2×SSC, 0.1% SDS at 50–65° C. wherein said nucleic acid molecule encodes a sulfate adenylate transferase subunit 2 polypeptide.

7. An isolated nucleic acid molecule comprising the nucleic acid molecule of claim 1 and a nucleotide sequence encoding a heterologous polypeptide.

8. A vector comprising the nucleic acid molecule of claim 1.

9. The vector of claim 8, which is an expression vector.

10. A host cell transfected with the expression vector of claim 9.

11. The host cell of claim 10, wherein said cell is a microorganism.

12. The host cell of claim 11, wherein said cell belongs to the genus *Corynebacterium* or *Brevibacterium*.

13. The host cell of claim 10, wherein the expression of said nucleic acid molecule results in the modulation in production of a fine chemical from said cell.

14. The host cell of claim 13, wherein said fine chemical is selected from the group consisting of: organic acids, proteinogenic and nonproteinogenic amino acids, purine and pyrimidine bases, nucleosides, nucleotides, lipids, saturated and unsaturated fatty acids, diols, carbohydrates, aromatic compounds, vitamins, cofactors, polyketides, and enzymes.

15. An isolated nucleic acid molecule which encodes a polypeptide comprising an amino acid sequence at least 90% identical to the amino acid sequence of SEQ ID NO:2, wherein said polypeptide is a sulfate adenylate transferase subunit 2 polypeptide.

* * * * *

UNITED STATES PATENT AND TRADEMARK OFFICE
CERTIFICATE OF CORRECTION

PATENT NO. : 6,831,165 B1
DATED : December 14, 2004
INVENTOR(S) : Markus Pompejus et al.

Page 1 of 1

It is certified that error appears in the above-identified patent and that said Letters Patent is hereby corrected as shown below:

Column 113,
Line 27, insert a space between "6X" and "SSC" so it should correctly appear as:
-- 6X SSC --;
Line 27, replace "45°C.," with -- 45°C, --;
Line 28, insert a space between "0.2X" and "SSC" so it should correctly appear as:
-- 0.2X SSC --;
Line 28, replace "50-65°C.," with -- 50-65°C, --;
Line 30, after the words "subunit 2" insert the word -- polypeptide --;
Line 41, insert a space between "6X" and "SSC" so it should correctly appear as:
-- 6X SSC --;
Line 42, replace "45°C.," with -- 45°C, --;
Line 42, insert a space between "0.2X" and "SSC" so it should correctly appear as:
-- 0.2X SSC --; and
Line 43, replace "50-60°C." with -- 50-60°C, -- so it should correctly appear as:
-- 50-60°C, wherein --.

Signed and Sealed this

Thirteenth Day of September, 2005

JON W. DUDAS
*Director of the United States Patent and Trademark Office*